United States Patent
Cosgrove et al.

(10) Patent No.: US 12,221,608 B2
(45) Date of Patent: *Feb. 11, 2025

(54) COMPOSITIONS, SYSTEMS, AND METHODS FOR REGULATION OF HEPATITIS B VIRUS THROUGH TARGETED GENE REPRESSION

(71) Applicant: Tune Therapeutics, Inc., Seattle, WA (US)

(72) Inventors: Brian Cosgrove, Durham, NC (US); Kendra Congdon, Durham, NC (US); Jason Dean, Seattle, WA (US); Veronica Gough, Durham, NC (US); Joshua B. Black, Durham, NC (US); Britta Jones, Durham, NC (US)

(73) Assignee: Tune Therapeutics, Inc., Seattle, WA (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/452,508

(22) Filed: Aug. 18, 2023

(65) Prior Publication Data

US 2024/0067968 A1 Feb. 29, 2024

Related U.S. Application Data

(60) Provisional application No. 63/531,309, filed on Aug. 7, 2023, provisional application No. 63/472,236, filed on Jun. 9, 2023, provisional application No. 63/399,634, filed on Aug. 19, 2022.

(51) Int. Cl.
| | |
|---|---|
| *C12N 15/113* | (2010.01) |
| *C12N 9/22* | (2006.01) |
| *C12N 15/11* | (2006.01) |
| *C12N 15/88* | (2006.01) |

(52) U.S. Cl.
CPC ............ *C12N 15/1131* (2013.01); *C12N 9/22* (2013.01); *C12N 15/11* (2013.01); *C12N 15/88* (2013.01); *C12N 2310/11* (2013.01); *C12N 2310/20* (2017.05); *C12N 2310/315* (2013.01); *C12N 2310/321* (2013.01); *C12N 2310/351* (2013.01)

(58) Field of Classification Search
None
See application file for complete search history.

(56) References Cited

U.S. PATENT DOCUMENTS

| | | | |
|---|---|---|---|
| 4,737,323 A | 4/1988 | Martin et al. | |
| 5,219,740 A | 6/1993 | Miller et al. | |
| 6,140,081 A | 10/2000 | Barbas | |
| 6,207,453 B1 | 3/2001 | Maass et al. | |
| 6,453,242 B1 | 9/2002 | Eisenberg et al. | |
| 6,534,261 B1 | 3/2003 | Cox et al. | |
| 7,074,596 B2 | 7/2006 | Darzynkiewicz et al. | |
| 7,745,651 B2 | 6/2010 | Heyes et al. | |
| 7,799,565 B2 | 9/2010 | Maclachlan et al. | |
| 8,278,036 B2 | 10/2012 | Kariko et al. | |
| 8,450,107 B1 | 5/2013 | Zhang et al. | |
| 8,586,526 B2 | 11/2013 | Gregory et al. | |
| 9,139,554 B2 | 9/2015 | Hope et al. | |
| 9,458,205 B2 | 10/2016 | Gregory et al. | |
| 10,723,692 B2 | 7/2020 | Ansell et al. | |
| 10,745,714 B2 | 8/2020 | Gersbach | |
| 10,941,395 B2 | 3/2021 | Yin et al. | |
| 11,072,782 B2 | 7/2021 | Cathomen et al. | |
| 2002/0160940 A1 | 10/2002 | Case et al. | |
| 2004/0142025 A1 | 7/2004 | Maclachlan et al. | |
| 2007/0042031 A1 | 2/2007 | Maclachlan et al. | |
| 2007/0059795 A1 | 3/2007 | Moore et al. | |
| 2007/0192880 A1 | 8/2007 | Muyan et al. | |
| 2012/0207744 A1 | 8/2012 | Mendlein et al. | |
| 2016/0010076 A1* | 1/2016 | Joung | C12N 15/11 435/375 |

(Continued)

FOREIGN PATENT DOCUMENTS

| | | |
|---|---|---|
| CN | 104711257 | 6/2015 |
| CN | 106701763 | 5/2017 |

(Continued)

OTHER PUBLICATIONS

Singh et al., Silencing hepatitis B virus covalently closed circular DNA: The potential of an epigenetic therapy approach. World Journal of Gastroenterology (2021), 27: 3182-3207 (Year: 2021).*
Zhang et al., Comparative Analysis of CpG Islands among HBV Genotypes. PLOS One (2013), 8, e56711: 1-8 (Year: 2013).*
U95551.1, Hepatitis B virus subtype ayw, complete genome, https://www.ncbi.nlm.nih.gov/nucleotide/U95551.1 [retrieved May 20, 2024] (Year: 1997).*

(Continued)

*Primary Examiner* — Celine X Qian
*Assistant Examiner* — Catherine Konopka
(74) *Attorney, Agent, or Firm* — MORRISON & FOERSTER LLP

(57) ABSTRACT

Provided herein are epigenetic-modifying DNA-targeting systems, such as CRISPR-Cas/guide RNA (gRNA) systems, for the transcriptional repression of Hepatitis B viral (HBV) genes to promote a cellular phenotype that leads to the reduction of HBV infection. In some embodiments, the epigenetic-modifying DNA-targeting systems bind to or target a target site of at least one gene or regulatory element thereof in a Hepatitis B viral DNA sequence in cell. In some aspects, the provided systems relate to the transcriptional repression of one or more Hepatitis B viral gene and/or regulatory element thereof. In some aspects, also provided herein are methods and uses related to the provided compositions, for example in repressing Hepatitis B viral replication and expression in connection with Hepatitis B infections.

26 Claims, 48 Drawing Sheets

Specification includes a Sequence Listing.

(56) References Cited

U.S. PATENT DOCUMENTS

| | | | |
|---|---|---|---|
| 2019/0127713 A1 | 5/2019 | Gersbach et al. | |
| 2020/0389425 A1* | 12/2020 | Bhatia | C12N 15/63 |
| 2022/0364124 A1 | 11/2022 | Gersbach et al. | |

FOREIGN PATENT DOCUMENTS

| | | | |
|---|---|---|---|
| EP | 3 957 734 | 2/2022 | |
| WO | WO-1993024640 A2 | 12/1993 | |
| WO | WO-1998053058 A1 | 11/1998 | |
| WO | WO-1998053059 A1 | 11/1998 | |
| WO | WO-1998053060 A1 | 11/1998 | |
| WO | WO-2002016536 A1 | 2/2002 | |
| WO | WO-2003016496 A2 | 2/2003 | |
| WO | WO-2003072788 A1 | 9/2003 | |
| WO | WO-2010144740 A1 | 12/2010 | |
| WO | WO-2013176772 A1 | 11/2013 | |
| WO | WO-2014093655 A2 | 6/2014 | |
| WO | WO-2014093661 A2 | 6/2014 | |
| WO | WO-2014152432 A2 | 9/2014 | |
| WO | WO-2014191128 A1 | 12/2014 | |
| WO | WO-2014197748 A2 | 12/2014 | |
| WO | WO-2015035136 A2 | 3/2015 | |
| WO | WO-2015/089465 | 6/2015 | |
| WO | WO-2015089427 A1 | 6/2015 | |
| WO | WO-2015161276 A2 | 10/2015 | |
| WO | WO-2015199952 A1 | 12/2015 | |
| WO | WO-2016011070 A2 | 1/2016 | |
| WO | WO-2016049258 A2 | 3/2016 | |
| WO | WO-2016/054106 | 4/2016 | |
| WO | WO-2016063264 A1 | 4/2016 | |
| WO | WO-2016114972 A1 | 7/2016 | |
| WO | WO-2016123578 A1 | 8/2016 | |
| WO | WO-2016130600 A2 | 8/2016 | |
| WO | WO-2016/197132 | 12/2016 | |
| WO | WO-2017/058795 | 4/2017 | |
| WO | WO-2017/070284 | 4/2017 | |
| WO | WO-2017075531 A1 | 5/2017 | |
| WO | WO-2017093969 A1 | 6/2017 | |
| WO | WO-2017180915 A2 | 10/2017 | |
| WO | WO-2017189308 A1 | 11/2017 | |
| WO | WO-2017193107 A2 | 11/2017 | |
| WO | WO-2017197238 A1 | 11/2017 | |
| WO | WO-2018/005873 | 1/2018 | |
| WO | WO-2019204766 A1 | 10/2019 | |
| WO | WO-2021076744 A1 | 4/2021 | |
| WO | WO-2021226077 A2 | 11/2021 | |
| WO | WO-2021226555 A2 | 11/2021 | |
| WO | WO-2021247570 A2 * | 12/2021 | A61K 31/7088 |
| WO | WO-2022067033 A1 | 3/2022 | |
| WO | WO-2022140577 A2 | 6/2022 | |
| WO | WO-2022/162247 | 8/2022 | |
| WO | WO-2024/064910 | 3/2024 | |

OTHER PUBLICATIONS

Nakamura et al., CRISPR technologies for precise epigenome editing. Nature Cell Biology (2021), 23: 11-22 (Year: 2021).*
Tu et al., HBV DNA Integration: Molecular Mechanisms and Clinical Implications. Viruses (2017), 9:75, doi: 10.3390/v9040075 (Year : 2017).*
Luo et al., Engineered zinc-finger transcription factors inhibit the replication and transcription of HBV in vitro and in vivo. International Journal of Molecular Medicine (2018), 41: 2169-2176 (Year: 2018).*
Liu et al., Inhibition of hepatitis B virus by the CRISPR/Cas9 system via targeting the conserved regions of the viral genome. Journal of General Virology (2015), 96: 2252-2261 (Year: 2015).*
Guo et al., In vitro cell culture models to study hepatitis B and D virus infection. Front. Microbiol. (2023), 14:1169770 (Year: 2023).*
Xirong et al., Hepatitis B Virus Can Be Inhibited by DNA Methyltransferase 3a via Specific Zinc-Finger-Induced Methylation of the X Promoter Biochemistry (Moscow) (2014), 79: 111-123 (Year: 2014).*
U.S. Appl. No. 18/452,514, filed Aug. 18, 2023, by Cosgrove.
Kampmann, "CRISPRi and CRISPRa screens in mammalian cells for precision biology and medicine," ACS Chem Biol. (2018) 13(2):406-416.
Kostyushev et al., "Crispr/cas and Hepatitis B therapy: technological advances and practical barriers" Nucleic Acid Ther. (2022) 32(1):14-28.
Li et al., "An Effective Molecular Target Site in Hepatitis B Virus S Gene for Cas9 Cleavage and Mutational Inactivation," Int J Biol Sci. (2016) 12(9):1104-1113.
Yan et al., "Inhibition of Hepatitis B Virus by AAV8-Derived CRISPR/SaCas9 Expressed From Liver-Specific Promoters," Frontiers in Microbiology (2021) 12: pp. 1-11.
Yang et al., "Permanent Inactivation of HBV Genomes by CRISPR/Cas9-Mediated Non-cleavage Base Editing," Molecular Therapy: Nucleic Acids (2020) 20:480-490.
Bloom et al., "Inhibition of replication of hepatitis B virus using transcriptional repressors that target the viral DNA," BMC Infectious Diseases, vol. 19, No. 802, pp. 1-10, Sep. 12, 2019 (Sep. 12, 2019), DOI: 10.1186/s12879-019-4436-y.
Bloom et al., "Inactivation of hepatitis B virus replication in cultured cells and in vivo with engineered transcription activator-like effector nucleases," Mol Ther, vol. 21, No. 10, 1889-1897 (2013), doi: 10.1038/mt.2013.170.
Chen et al., (2014) "An efficient antiviral strategy for targeting hepatitis B virus genome using transcription activator-like effector nucleases," Mol Ther, vol. 22, No. 2, 303-311, doi: 10.1038/mt.2013.212.
Cradick et al., (2010) "Zinc-finger nucleases as a novel therapeutic strategy for targeting hepatitis B virus DNAs," Mol Ther, vol. 18, No. 5, 947-954, doi: 10.1038/mt.2010.20.
Dong et al., (2015) "Targeting hepatitis B virus cccDNA by CRISPR/Cas9 nuclease efficiently inhibits viral replication," Antiviral Res 118, 110-117, doi: 10.1016/j.antiviral.2015.03.015.
Fu et al., "Designed Artificial Transcription Factors Inhibit Hepatitis B Virus Transcription in HepG2.2.15 Cells," Ann Clin Lab Sci., vol. 50, No. 1, Jan. 2020 (Jan. 2020), pp. 92-98.
Hensel et al., "Virus-host interplay in hepatitis B virus infection and epigenetic treatment strategies," The FEBS Journal, vol. 284, No. 21, May 19, 2017 (May 19, 2017), pp. 3550-3572, DOI: 10.1111/febs.14094.
Karimova et al., (2015) "CRISPR/Cas9 nickase-mediated disruption of hepatitis B virus open reading frame S and X," Sci Rep, 5, 13734, doi: 10.1038/srep13734.
Kennedy et al., (2015) "Targeting hepatitis B virus cccDNA using CRISPR/Cas9," Antiviral Res 123, 188-192, doi: 10.1016/j.antiviral.2015.10.004.
Kennedy et al., (2015) "Suppression of hepatitis B virus DNA accumulation in chronically infected cells using a bacterial CRISPR/Cas RNA-guided DNA endonuclease," Virology 476, 196-205, doi: 10.1016/j.virol.2014.12.001.
Lin et al., (2014) "The CRISPR/Cas9 System Facilitates Clearance of the Intrahepatic HBV Templates In Vivo," Molecular therapy Nucleic acids 3, e186, pp. 1-7, doi: 10.1038/mtna.2014.38.
Liu et al., (2015) "Inhibition of hepatitis B virus by the CRISPR/Cas9 system via targeting the conserved regions of the viral genome," J Gen Virol 96, 2252-2261, doi: 10.1099/vir.0.000159.
Luo et al., "Engineered zinc-finger transcription factors inhibit the replication and transcription of HBV in vitro and in vivo," International Journal of Molecular Medicine, 41: 2169-2176, Jan. 17, 2018 (Jan. 17, 2018), DOI:10.3892/ijmm.2018.3396.
Ramanan et al., (2015) "CRISPR/Cas9 cleavage of viral DNA efficiently suppresses hepatitis B virus," Sci Rep, 5, 10833, pp. 1-9, doi: 10.1038/srep10833.
Rendon Londono, "Genetic characterizations and epigenetic interference to better understand and fight occult Hepatitis B virus infection," Ph. D. thesis, University of Groningen, 2017, pp. 1-281.
Seeger et al., (2014) "Targeting Hepatitis B Virus With CRISPR/Cas9," Molecular Therapy Nucleic Acids, 3, e216, pp. 1-7, doi: 10.1038/mtna.2014.68.
Singh et al., "Silencing hepatitis B virus covalently closed circular DNA: The potential of an epigenetic therapy approach," World

(56) References Cited

OTHER PUBLICATIONS

Journal of Gastroenterology, vol. 27, No. 23, Jun. 21, 2021 (Jun. 21, 2021), pp. 3182-3207, DOI: 10.3748/wjg.v27.i23.3182.
Sung et al., "CRISPR-mediated promoter de/methylation technologies for gene regulation," Archives of Pharmacal Research, vol. 43, No. 7, Jul. 28, 2020 (Jul. 28, 2020), pp. 705-713, DOI: 10.1007/s12272-020-01257-8.
Wang et al., (2015) "Dual gRNAs guided CRISPR/Cas9 system inhibits hepatitis B virus replication," World J Gastroenterol, vol. 21, No. 32, 9554-9565, doi: 10.3748/wjg.v21.i32.9554.
Weber et al., (2014) "AAV-mediated delivery of zinc finger nucleases targeting hepatitis B virus inhibits active replication," PLoS ONE, 9(5): e97579, pp. 1-14, doi: 10.1371/journal.pone.0097579.
Xiong et al., "Targeted DNA methylation in human cells using engineered dCas9-methyltransferases," Scientific Reports, 7:6732, pp. 1-14, Jul. 27, 2017 (Jul. 27, 2017), DOI: 10.1038/s41598-017-06757-0.
Xirong et al., "Hepatitis B virus can be inhibited by DNA methyltransferase 3a via specific zinc-finger-induced methylation of the X promoter," Biochemistry (Moscow), vol. 79, No. 2, 111-123, Feb. 14, 2014 (Feb. 14, 2014) DOI: 10.1134/S0006297914020047.
Zhao et al. (2012) "Creation of a six-fingered artificial transcription factor that represses the hepatitis B virus HBx gene integrated into a human hepatocellular carcinoma cell line," J Biomol Screen, 18(4), 378-387, doi: 10.1177/1087057112463066.
Zhu et al., (2016) "CRISPR/Cas9 produces anti-hepatitis B virus effect in hepatoma cells and transgenic mouse," Virus Res 217, 125-132, doi: 10.1016/j.virusres.2016.04.003.
Adli, (2018). "The CRISPR tool kit for genome editing and beyond," Nat. Commun, 9:1911, 13 pages.
Allweiss et al., (2014). "Immune cell responses are not required to induce substantial hepatitis B virus antigen decline during pegylated interferon-alpha administration," Journal of Hepatology, 60(3):500-507.
Allweiss et al., (2022). "Therapeutic shutdown of HBV transcripts promotes reappearance of the SMC5/6 complex and silencing of the viral genome in vivo," Gut, 71(2):372-381.
Alonso-Camino et al., (2013). "CARbodies: Human Antibodies Against Cell Surface Tumor Antigens Selected From Repertoires Displayed on T Cell Chimeric Antigen Receptors," Mol Ther Nucl Acids, 2:e93, 11 pages.
Arauz-Ruiz et.al., (2002). "Genotype H: a new Amerindian genotype of hepatitis B virus revealed in Central America," J Gen Virol, 83(Pt 8):2059-2073.
Belloni et al., (2012). "IFN-α inhibits HBV transcription and replication in cell culture and in humanized mice by targeting the epigenetic regulation of the nuclear cccDNA minichromosome," Journal of Clinical Investigation, 122(2):529-537.
Bhakta et al., (2010). "The generation of zinc finger proteins by modular assembly," Methods Mol. Biol., 649:3-30, 25 pages.
Billioud et al., (2015). "In vivo reduction of hepatitis B virus antigenemia and viremia by antisense oligonucleotides," Journal of Hepatology, 64(4):781-789.
Boris-Lawrie et al., (1993). "Recent advances in retrovirus vector technology," Cur. Opin. Genet. Develop., 3:102-109.
Bourlière et al., (2017). "ANRS HB06 PEGAN Study Group. Effect on HBs antigen clearance of addition of pegylated interferon alfa-2a to nucleos(t)ide analogue therapy versus nucleos(t)ide analogue therapy alone in patients with HBe antigen-negative chronic hepatitis B and sustained undetectable plasma hepatitis B virus DNA: a randomised, controlled, open-label trial," Lancet Gastroenterol Hepatol, 2(3):177-188.
Brash et al., (1987). "Strontium phosphate transfection of human cells in primary culture: stable expression of the simian virus 40 large-T-antigen gene in primary human bronchial epithelial cells," Mol. Cell Biol., 7(5):2031-2034.
Burns et al., (1993). "Vesicular stomatitis virus G glycoprotein pseudotyped retroviral vectors: concentration to very high titer and efficient gene transfer into mammalian and nonmammalian cells," Proc. Natl. Acad. Sci. USA, 90:8033-8037.

Burns et al., (2014). "Viral hepatitis B: clinical and epidemiological characteristics," Cold Spring Harb Perspect Med, 4(12):a024935, 14 pages.
Carlens et al. (2000). "Ex vivo T lymphocyte expansion for retroviral transduction: influence of serum-free media on variations in cell expansion rates and lymphocyte subset distribution," Exp Hematol, 28(10):1137-1146.
Carrillo et al., (1988). "The Multiple Sequence Alignment Problem in Biology," SIAM J Applied Math, 48(5):1073-1082.
Cavalieri et al., (2003). "Human T lymphocytes transduced by lentiviral vectors in the absence of TCR activation maintain an intact immune competence," Blood, 102(2):497-505.
Chen et al., (2013). "Fusion protein linkers: property, design and functionality," Adv. Drug Deliv. Rev., 65(10):1357-1369.
Chen et al., (2021). "Pacbio Sequencing of PLC/PRF/5 Cell Line and Clearance of HBV Integration Through CRISPR/Cas-9 System," Frontiers in Molecular Biosciences, 8:676957, 11 pages.
Chicaybam et al., (2013). "An efficient low cost method for gene transfer to T lymphocytes," PLoS ONE, 8(3):e60298, 11 pages.
Chylinski et al., (2013). "The tracrRNA and Cas9 families of type II CRISPR-Cas immunity systems," RNA Biol., 10(5):726-737.
Cong et al., (2013). "Multiplex genome engineering using CRISPR/Cas systems," Science, 339(6121):819-823, 9 pages.
Cooper et al., (2003). "T-cell clones can be rendered specific for CD19: toward the selective augmentation of the graft-versus-B-lineage leukemia effect," Blood, 101(4):1637-1644.
Dandri, (2020). "Epigenetic modulation in chronic hepatitis B virus infection," Semin Immunopathol, 42(2):173-185.
Dejeux et al., (2007). "Rapid Identification of Promoter Hypermethylation in Hepatocellular Carcinoma by Pyrosequencing of Etiologically Homogeneous Sample Pools," J. Mol. Diagn., 9(4):510-520.
Eads et al., (2000). "MethyLight: a high-throughput assay to measure DNA methylation," Nucleic Acids Res., 28(8):e32, 8 pages.
Ehrlich et al., (2002). "Hypomethylation and hypermethylation of DNA in Wilms tumors," Oncogene, 21:6694-6702.
European Association for the Study of the Liver, (2017). "EASL 2017 Clinical Practice Guidelines on the management of hepatitis B virus infection," J Hepatol, 67(2):370-398.
Fine et al., (2015). "Trans-spliced Cas9 allows cleavage of HBB and CCR5 genes in human cells using compact expression cassettes," Sci. Rep., 5:10777, 9 pages.
Gaj et al., (2013). "ZFN, TALEN, and CRISPR/Cas-based methods for genome engineering," Trends Biotechnol, 31(7):397-405.
Gane et al., (2021). "Clinical Study of Single-Stranded Oligonucleotide RO7062931 in Healthy Volunteers and Patients With Chronic Hepatitis B," Hepatology, 74(4):1795-1808.
Gardiner-Garden et al., (1987). "CpG islands in vertebrate genomes," J Mol Biol, 196:261-282.
GenBank, (1997). "Accession No. U95551.1; Hepatitis B virus subtype ayw, complete genome," available online at <https://www.ncbi.nlm.nih.gov/nuccore/U95551>, 2 pages.
Gersbach et al., (2014). "Synthetic zinc finger proteins: the advent of targeted gene regulation and genome modification technologies," Acc. Chem. Res., 47(8):2309-18.
Ghaleh et al., (2020). "Concise review on optimized methods in production and transduction of lentiviral vectors in order to facilitate immunotherapy and gene therapy," Biomed. Pharmacother, 128:110276, 11 pages.
Gilbert et al., (2013). "CRISPR-mediated modular RNA-guided regulation of transcription in eukaryotes," Cell, 154(2):442-451.
Gowher et al., (2002). "Molecular enzymology of the catalytic domains of the Dnmt3a and Dnmt3b DNA methyltransferases," J. Biol. Chem., 277(23):20409-20414.
Gowher et al., (2005). "Mechanism of stimulation of catalytic activity of Dnmt3A and Dnmt3B DNA-(cytosine-C5)-methyltransferases by Dnmt3L," J. Biol. Chem., 280(14):13341-13348.
Graumann et al., (2015). "Genomic Methylation Inhibits Expression of Hepatitis B Virus Envelope Protein in Transgenic Mice: A Non-Infectious Mouse Model to Study Silencing of HBV Surface Antigen Genes," PLoS One, 10(12):e0146099, 13 pages.

(56) References Cited

OTHER PUBLICATIONS

Groner et al., (2010). "KRAB—Zinc Finger Proteins and KAP1 Can Mediate Long-Range Transcriptional Repression through Heterochromatin Spreading," PLoS Genet., 6(3):e1000869, 14 pages.
Hatit et al., (2022). "Species-dependent in vivo mRNA delivery and cellular responses to nanoparticles," Nat Nanotechnol, 17(3):310-318, 23 pages.
Huang et al., (2009). "Ch 9: DNA transposons for modification of human primary T lymphocytes," Methods Mol Biol, 506:115-126.
Ishida et al., (2015). "Novel robust in vitro hepatitis B virus infection model using fresh human hepatocytes isolated from humanized mice," Am J Pathol, 185(5):1275-1285.
Jain et al., (2015). "Comprehensive DNA methylation analysis of hepatitis B virus genome in infected liver tissues," Scientific Reports, 5:10478, 11 pages.
Jia et al., (2007). "Structure of Dnmt3a bound to Dnmt3L suggests a model for de novo DNA methylation," Nature, 449(7159):248-251, 10 pages.
Jinek et al., (2012). "A programmable dual-RNA-guided DNA endonuclease in adaptive bacterial immunity," Science, 337(6096):816-821.
Johnston, (1990). "Biolistic transformation: microbes to mice," Nature, 346:776-777.
Kasaraneni et al., (2018). "A simple strategy for retargeting lentiviral vectors to desired cell types via a disulfide-bond-forming protein-peptide pair," Sci. Rep., 8(1):10990, 9 pages.
Kearns et al., (2015). "Functional annotation of native enhancers with a Cas9-histone demethylase fusion," Nat. Methods, 12(5):401-403, 13 pages.
Koste et al., (2014). "T-cell receptor transfer into human T cells with ecotropic retroviral vectors," Gene Ther, 21(5):533-538.
Koumbi et al., (2016). "Hepatitis B viral replication influences the expression of natural killer cell ligands," Annals of Gastroenterology, 29:348-357.
Koumbi et al., (2016). "Hepatitis B virus basal core promoter mutations show lower replication fitness associated with cccDNA acetylation status," Virus Res, 220:150-160.
Lebossé et al., (2020). "Quantification and epigenetic evaluation of the residual pool of hepatitis B covalently closed circular DNA in long-term nucleoside analogue-treated patients," Sci Rep, 10(1):21097, 12 pages.
Lee et al., (2008). "Quantitative promoter hypermethylation analysis of cancer-related genes in salivary gland carcinomas: comparison with methylation-specific PCR technique and clinical significance," Clinical Cancer Research, 14(9):2664-2672.
Lei et al., (2017). "Targeted DNA methylation in vivo using an engineered dCas9-MQ1 fusion protein," Nat. Commun, 8:16026, 10 pages.
Li et al., (2017). "Development of fluorescent methods for DNA methyltransferase assay," Methods Appl. Fluoresc., 5:012002, 8 pages.
Liu et al., (1997). "Design of polydactyl zinc-finger proteins for unique addressing within complex genomes," PNAS, 94(11):5525-5530.
Liu et al., (2016). "Editing DNA Methylation in the Mammalian Genome," Cell, 167:233-247, 32 pages.
Lucifora et al., (2014). "Specific and nonhepatotoxic degradation of nuclear hepatitis B virus cccDNA," Science, 343(6176):1221-1228, 22 pages.
Lucifora et al., (2016). "Attacking hepatitis B virus cccDNA—The holy grail to hepatitis B cure," Journal of Hepatology, 64:S41-S48.
Ma et al., (2014). "Pol III Promoters to Express Small RNAs: Delineation of Transcription Initiation," Molecular Therapy—Nucleic Acids, 3:e161, 11 pages.
Maeder et al., (2013). "CRISPR RNA-guided activation of endogenous human genes," Nat. Methods, 10(10):977-979, 9 pages.
Makarova et al., (2015). "Annotation and Classification of CRISPR-Cas Systems," Methods Mol. Biol, 1311:47-75, 27 pages.
Mali et al., (2013). "RNA-guided human genome engineering via Cas9," Science, 339(6121):823-826, 8 pages.
Mali et al., (2013). "CAS9 transcriptional activators for target specificity screening and paired nickases for cooperative genome engineering," Nat. Biotechnol, 31(9):833-838, 17 pages.
Manuri et al., (2010). "piggyBac transposon/transposase system to generate CD19-specific T cells for the treatment of B-lineage malignancies," Hum Gene Ther, 21(4):427-437.
Marcellin et al., (2004). "Peginterferon alfa-2a alone, lamivudine alone, and the two in combination in patients with HBeAg-negative chronic hepatitis B," New England Journal of Medicine, 351(12):1206-1217.
Marcellin et al., (2016). "Combination of Tenofovir Disoproxil Fumarate and Peginterferon α-2a Increases Loss of Hepatitis B Surface Antigen in Patients With Chronic Hepatitis B," Gastroenterology, 150(1):134-144, 21 pages.
Mavrothalassitis et al., (2000). "Proteins of the ETS family with transcriptional repressor activity," Oncogene, 19:6524-6532.
Micco et al., (2013). "Differential boosting of innate and adaptive antiviral responses during pegylated-interferon-alpha therapy of chronic hepatitis B," Journal of Hepatology, 58(2):225-233.
Michailidis et al., (2020). "Expansion, in vivo-ex vivo cycling, and genetic manipulation of primary human hepatocytes," PNAS, 117(3):1678-1688.
Miller et al., (1989). "Improved retroviral vectors for gene transfer and expression," Bio Techniques, 7(9):980-990, 14 pages.
Miller, (1990). "Retrovirus packaging cells," Human Gene Therapy, 1:5-14.
Milone et al., (2018). "Clinical use of lentiviral vectors," Leukemia, 32(7):1529-1541.
Mok et al., (1999). "Stabilized plasmid-lipid particles: factors influencing plasmid entrapment and transfection properties," Biochimica et Biophysica Acta, 1419(2):137-150.
Moon et al., (2019). "Recent advances in the CRISPR genome editing tool set," Exp. Mol. Med. 51(11):130, 11 pages.
Mulero-Navarro et al., (2006). "The dioxin receptor is silenced by promoter hypermethylation in human acute lymphoblastic leukemia through inhibition of Sp1 binding," Carcinogenesis, 27(5):1099-1104.
Nakagawachi et al., (2003). "Silencing effect of CpG island hypermethylation and histone modifications on O6-methylguanine-DNA methyltransferase (MGMT) gene expression in human cancer," Oncogene, 22:8835-8844.
Nassal, (2015). "HBV cccDNA: viral persistence reservoir and key obstacle for a cure of chronic hepatitis B," Gut, 64(12):1972-1984.
Norder et al., (1994). "Complete genomes, phylogenetic relatedness, and structural proteins of six strains of the hepatitis B virus, four of which represent two new genotypes," Virology, 198(2):489-503.
Nunez et al., (2021). "Genome-wide programmable transcriptional memory by CRISPR-based epigenome editing," Cell, 184(9):2503-2519, 35 pages.
O'Geen et al., (2019). "Ezh2-dCas9 and KRAB-dCas9 enable engineering of epigenetic memory in a context-dependent manner," Epigenetics Chromatin, 12(1):26, 20 pages.
Park et al., (2011). "Treating cancer with genetically engineered T cells," Trends Biotechnol, 29(11):550-557, 15 pages.
Perez-Pinera et al., (2013). "RNA-guided gene activation by CRISPR-Cas9-based transcription factors," Nat. Methods, 10(10):973-976, 12 pages.
Poh et al., (2016). "DNA Methyltransferase Activity Assays: Advances and Challenges," Theranostics, 6(3):369-391.
Pollicino et al., (2006). "Hepatitis B virus replication is regulated by the acetylation status of hepatitis B virus cccDNA-bound H3 and H4 histones," Gastroenterology, 130(3):823-837.
Pollicino et al., (2014). "Hepatitis B virus PreS/S gene variants: pathobiology and clinical implications," Journal of Hepatology, 61(2):408-417.
Qi et al., (2013). "Repurposing CRISPR as an RNA-guided platform for sequence-specific control of gene expression," Cell, 152(5):1173-1183, 13 pages.
Quarleri, (2014). "Core promoter: A critical region where the hepatitis B virus makes decisions," World J Gastroenterol, 20(2):425-435, 17 pages.

(56) References Cited

OTHER PUBLICATIONS

Riviere et al., (2015). "HBx relieves chromatin-mediated transcriptional repression of hepatitis B viral cccDNA involving SETDB1 histone methyltransferase," J Hepatol, 63(5):1093-1102, 34 pages.
Scarpa et al., (1991). "Characterization of recombinant helper retroviruses from moloney-based vectors in ecotropic and amphotropic packaging cell lines," Virology, 180:849-852.
Schellenberger et al., (2009). "A recombinant polypeptide extends the in vivo half-life of peptides and proteins in a tunable manner," Nature Biotechnology, 27(12):1186-1190. 7 pages.
Schweitzer et al., (2015). "Estimations of worldwide prevalence of chronic hepatitis B virus infection: a systematic review of data published between 1965 and 2013," Lancet, 386(10003):1546-1555.
Seeger et al., (2015). "Molecular biology of hepatitis B virus infection," Virology, 479-480:672-686.
Sharma et al., (2013). "Efficient Sleeping Beauty DNA Transposition From DNA Minicircles," Molec Ther Nucl Acids, 2(2):e74, 10 pages.
Song et al., (2021). "Functional cure for chronic hepatitis B: accessibility, durability, and prognosis," Virol J, 18(1):114, 6 pages.
Stelma et al., (2015). "Natural Killer Cell Characteristics in Patients With Chronic Hepatitis B Virus (HBV) Infection Are Associated With HBV Surface Antigen Clearance After Combination Treatment With Pegylated Interferon Alfa-2a and Adefovir," Journal of Infectious Disease, 212(7):1042-1051.
Stuyver et.al., (2000). "A new genotype of hepatitis B virus: complete genome and phylogenetic relatedness," J Gen Virol., 81(Pt 1):67-74.
Suslov et al., (2021). "Transition to HBeAg-negative chronic hepatitis B virus infection is associated with reduced cccDNA transcriptional activity," J Hepatology, 74(4):794-800.
Tanenbaum et al., (2014). "A protein-tagging system for signal amplification in gene expression and fluorescence imaging," Cell, 159(3):635-646.
Terrault et al., (2016). "AASLD guidelines for treatment of chronic hepatitis B," Hepatology, 63(1):261-283.
Thakore et al., (2018). "RNA-guided transcriptional silencing in vivo with S. aureus CRISPR-Cas9 repressors," Nat Commun, 9(1):1674, 9 pages.
Tropberger et al., (2015). "Mapping of histone modifications in episomal HBV cccDNA uncovers an unusual chromatin organization amenable to epigenetic manipulation," PNAS, 112(42):E5715-E5724.
Truong et al., (2015). "Development of an intein-mediated split-Cas9 system for gene therapy," Nucleic Acids Res, 43(13):6450-6458.
Tsai, (2021). "Review of Current and Potential Treatments for Chronic Hepatitis B Virus Infection," Gastroenterol Hepatol, 17(8):367-376.
Urrutia, (2003). "KRAB-containing zinc-finger repressor proteins," Genome Biol, 4(10):231, 8 pages.
Van Tedeloo et al., (2000). "High-level transgene expression in primary human T lymphocytes and adult bone marrow CD34+ cells via electroporation-mediated gene delivery," Gene Therapy, 7(16):1431-1437.
Verhoeyen et al., (2009). "Ch 8: Lentiviral vector gene transfer into human T cells," Methods Mol Biol, 506:97-114.
Vivekanandan et al., (2008). "Comprehensive genetic and epigenetic analysis of occult hepatitis B from liver tissue samples," Clin Infect Dis, 46(8):1227-1236.
Vivekanandan et al., (2009). "Methylation Regulates Hepatitis B Viral Protein Expression," Journal of Infectious Diseases, 199(9):1286-1291.
Vivekanandan et al., (2010). "Hepatitis B Virus Replication Induces Methylation of both Host and Viral DNA," Journal of Virology, 84(9):4321-4329.
Wang et al., (2012). "Phenotypic and functional attributes of lentivirus modified CD19-specific human CD8+ central memory T cells manufactured at clinical scale," J. Immunother, 35(9):689-701, 28 pages.
Wei et al., (2021). "Hepatitis B virus cccDNA is formed through distinct repair processes of each strand," Nature Communications, 12:1591, 13 pages.
Widschwendter et al., (2000). "Methylation and silencing of the retinoic acid receptor-beta2 gene in breast cancer," J Natl. Cancer Inst., 92(10):826-832.
Wright et al., (2006). "Standardized reagents and protocols for engineering zinc finger nucleases by modular assembly," Nat. Protoc., 1(3):1637-1652.
Wright et al., (2015). "Rational design of a split-Cas9 enzyme complex," PNAS, 112(10):2984-2989.
Yamasaki et al., (2010). "In vitro evaluation of cytochrome P450 and glucuronidation activities in hepatocytes isolated from liver-humanized mice," Drug Metab Pharmacokinet, 25(6):539-550.
Yamasaki et al., (2020). "Culture density contributes to hepatic functions of fresh human hepatocytes isolated from chimeric mice with humanized livers: Novel, long-term, functional two-dimensional in vitro tool for developing new drugs," PLoS One, 15(9):e0237809, 24 pages.
Yang et al., (2019). "HAT1 signaling confers to assembly and epigenetic regulation of HBV cccDNA minichromosome," Theranostics, 9(24):7345-7358.
Yang et al., (2020). "Entecavir add-on Peg-interferon therapy plays a positive role in reversing hepatic fibrosis in treatment-naïve chronic hepatitis B patients: a prospective and randomized controlled trial," Chin Med J (Engl), 133(14):1639-1648.
Yuen et al., (2022). "Efficacy and Safety of Bepirovirsen in Chronic Hepatitis B Infection," N Engl J Med, 387(21):1957-1968.
Zetsche et al., (2015). "A split-Cas9 architecture for inducible genome editing and transcription modulation," Nat. Biotechnol, 33(2):139-142, 6 pages.
Zetsche et al., (2015). "Cpf1 is a single RNA-guided endonuclease of a class 2 CRISPR-Cas system," Cell, 163(3):759-771.
Zhang et al., (2014). "Transcription of Hepatitis B Virus Covalently Closed Circular DNA Is Regulated by CpG Methylation during Chronic Infection," PlosOne, 9(10):e110442, 12 pages.
Zhang et al., (2015). "Genetic variation of hepatitis B virus and its significance for pathogenesis," World J Gastroenterol., 22(1):126-144, 34 pages.
Zhang, (2019). "Development of CRISPR-Cas systems for genome editing and beyond," Q. Rev. Biophys. 52:E6, 31 pages.
Zhao et al., (2020). "Insights into Hepatitis B Virus DNA Integration—55 Years after Virus Discovery," Cell Press—The Innovation, 1(2):100034, 10 pages.
Ma et al., (2020). "Nanomaterial-based biosensors for DNA methyltransferase assay," J Mater Chem B., 8:3488-3501.
Meier et al., (2017). "Hepatitis B virus covalently closed circular DNA homeostasis is independent of the lymphotoxin pathway during chronic HBV infection," J Viral Hepat, 24(8):662-671.
Papatheodoridis et al., (2002). "Nucleoside analogues for chronic hepatitis B: antiviral efficacy and viral resistance," Am. J. Gastroenterol, 97(7):1618-1628.
Sung et al., (2012). "Genome-wide survey of recurrent HBV integration in hepatocellular carcinoma," Nature Genetics, 44(7):765-769.
Vivekanandan et al., (2008). "Hepatitis B viral DNA is methylated in liver tissues," Journal of Viral Hepatitis, 15(2):103-107.
Bloomfield, (1981). "Quasi-Elastic Light Scattering Applications in Biochemistry and Biology," Ann. Rev. Biophys. Bioeng., 10:421-450.
Deng et al., (2014). "Highly sensitive electrochemical methyltransferase activity assay," Anal Chem., 86:2117-2123.
Flisiak et al., (2018). "siRNA drug development against hepatitis B virus infection," Expert Opinion on Biology Therapy, 18(6):609-617.
Gane, (2022). "The Roadmap Towards Cure of Chronic Hepatitis B Virus Infection," Journal of the Royal Society of New Zealand, 52(2):129-148.

(56) References Cited

OTHER PUBLICATIONS

Anglero-Rodrigues et.al., (2023). "Development of HBV-targeting epigenetic repressors with deep, durable in vivo silencing of viral markers," HBV International Meeting, 1 page.

Bourliere et al., (2017). "Effect on HBs antigen clearance of addition of pegylated interferon alfa-2a to nucleos(t)ide analogue therapy versus nucleos(t)ide analogue therapy alone in patients with HBe antigen-negative chronic hepatitis B and sustained undetectable plasma hepatitis B virus DNA: a randomised, controlled, open-label trial," The Lancet Gastroenterology & Hepatology, 2:177-188, 42 pages.

Fanning et al., (2019). "Therapeutic strategies for hepatitis B virus infection: towards a cure," Nature Reviews Drug Discovery, 18:827-844.

Ning et al., (2019). "Roadmap to functional cure of chronic hepatitis B: An expert consensus," J Viral Hepatitis, 26(10):1146-1155.

Amabile et al., (2016). "Inheritable Silencing of Endogenous Genes by Hit-and-Run Targeted Epigenetic Editing," Cell, 167(1):219-232.e14, 29 pages.

Ayyanathan et al., (2003). "Regulated recruitment of HP1 to a euchromatic gene induces mitotically heritable, epigenetic gene silencing: a mammalian cell culture model of gene variegation," Genes Dev, 17:1855-1869.

Braliou et al., (2001). "The v-ErbA oncoprotein quenches the activity of an erythroid-specific enhancer," Oncogene, 20(7):775-87.

Broude et al., (2007). "p21 (CDKN1A) is a negative regulator of p53 stability," Cell Cycle, 6(12):1468-1471.

Cortés-Mancera et al., (2022). "Gene-Targeted DNA Methylation: Towards Long-Lasting Reprogramming of Gene Expression?" Adv Exp Med Biol., 1389:515-533.

Hochstrasser et al., (2014). "CasA mediates Cas3-catalyzed target degradation during CRISPR RNA-guided interference," PNAS, 111(18):6618-23.

Kabadi et al., (2014). "Engineering Synthetic TALE and CRISPR/Cas9 Transcription Factors for Regulating Gene Expression," Methods, 69(2):188-197, 27 pages.

Kao et al., (2014). "Ectopic DNMT3L triggers assembly of a repressive complex for retroviral silencing in somatic cells," J Virol., 88(18):10680-95.

Kocak, (2013). "Thesis: Synthetic Transcription Factors and their Effects on Endogenous DNA Methylation in Human Cells," Department of Biomedical Engineering in the Graduate School of Duke University, 35 pages.

Kuhnel et al., (2004). "Tumor-specific adenoviral gene therapy: Transcriptional repression of gene expression by utilizing p53-signal transduction pathways," Cancer Gene Ther., 11(1):28-40.

Li et al., (2006). "The histone methyltransferase SETDB1 and the DNA methyltransferase DNMT3A interact directly and localize to promoters silenced in cancer cells," J. Biol. Chem., 281(28):19489-19500.

Li et al., (2007). "Chimeric DNA methyltransferases target DNA methylation to specific DNA sequences and repress expression of target genes," Nucleic Acids Res., 35(1):100-112.

Ma et al., (2014). "Targeted gene suppression by inducing de novo DNA methylation in the gene promoter," Epigenetics Chromatin, 7(20), 11 pages.

Moussa et al., (2021). "Here to stay: Writing lasting epigenetic memories," Cell, 184(9):2281-2283.

Murphy et al., (2016). "The Transcriptional Repressive Activity of KRAB Zinc Finger Proteins Does Not Correlate with Their Ability to Recruit TRIM28," PLoS ONE, 11(9):e0163555, 19 pages.

O'Geen et al., (2022). "Determinants of heritable gene silencing for KRAB-dCas9 + DNMT3 and Ezh2-dCas9 + DNMT3 hit-and-run epigenome editing," Nucleic Acids Res, 50(6):3239-3253.

Policarpi et al., (2021). "Epigenetic editing: Dissecting chromatin function in context," Bioessays, 43(5):e2000316, 16 pages.

Rivenbark et al., (2012). "Epigenetic reprogramming of cancer cells via targeted DNA methylation," Epigenetics, 7:350-360.

Schultz et al., (2002). "SETDBI: a novel KAP-1-associated histone H3, lysine 9-specific methyltransferase that contributes to HP1-mediated silencing of euchromatic genes by KRAB zinc-finger proteins," Genes & Development, 16:919-932.

Siddique et al., (2013). "Targeted methylation and gene silencing of VEGF-A in human cells by using a designed Dnmt3a-Dnmt3L single-chain fusion protein with increased DNA methylation activity," J. Mol. Biol., 425(3):479-491.

Tycko et al., (2020). "High-Throughput Discovery and Characterization of Human Transcriptional Effectors," Cell, 183(7):2020-2035, 33 pages.

Zhao et al., (2013). "Intracellular delivery of artificial transcription factors fused to the protein transduction domain of HIV-1 Tat," Protein Expr Purif, 90(1):27-33.

Alerasool et al., (2020). "An efficient KRAB domain for CRISPRi applications in human cells," Nat Methods, 17:1093-1096, 14 pages.

Fuks, (2005). "DNA methylation and histone modifications: teaming up to silence genes," Current Opinion in Genetics & Development, 15(5):490-495.

Kim et al., (2007). "Zinc-fingers and homeoboxes 1 (ZHX1) binds DNA methyltransferase (DNMT) 3B to enhance DNMT3B-mediated transcriptional repression," Biochemical and Biophysical Research Communications, 355(2):318-323.

Abaandou et al., (2021). "Affecting HEK293 Cell Growth and Production Performance by Modifying the Expression of Specific Genes," Cells, 10:1667, 21 pages.

Cano-Rodriguez et al., (2016). "Epigenetic Editing: On the Verge of Reprogramming Gene Expression at Will," Curr Genet Med Rep, 4:170-179.

Das et al., (2016). "Tet-On Systems For Doxycycline-inducible Gene Expression," Current Gene Therapy, 16:156-167.

Luo et al., (2014). "Repurposing endogenous type I CRISPR-Cas systems for programmable gene repression," Nucleic acids research, 43(1):674-681.

Orth et al., (2000). "Structural basis of gene regulation by the tetracycline inducible Tet repressor-operator system," natural structural biology, 7(3):215-219.

Stepper, (2020). "CRISPR-Cas9 fusions for synthetic epigenetics," Institute for Biochemistry and Technical Biochemistry at the University of Stuttgart, 148 pages.

Cheng, Alfred SL, et al. "RNA interference targeting HBx suppresses tumor growth and enhances cisplatin chemosensitivity in human hepatocellular carcinoma." Cancer letters (2007) 253:43-52.

"Drug Watch" (Jan. 17, 2022), https://web.archive.org/web/20220125112336/https://www.hepb.org/treatment-and-management/drug-watch/, retrieved Aug. 21, 2024.

Hayer et al., (2012) "HBVdb: a knowledge database for Hepatitis B Virus," Nucleic Acids Research, 41:D566-D570.

"Hepatitis B" (Apr. 9, 2024). https://www.who.int/news-room/fact-sheets/detail/hepatitis-b#:~:text=WHO%20estimates%20that%20254%20million,carcinoma%20(primary%20liver%20cancer), retrieved Aug. 21, 2024.

Lucifora et al., (2021) "Attacking hepatitis B virus cccDNA—The holy grail to hepatitis B cure," Journal of Hepatology 64(1):41-48.

McNaughton et al., (2020) "Analysis of genomic-length HBV sequences to determine genotype and subgenotype reference sequences," Journal of General Virology, 101:271-283.

Smekalova et al., "cccDNA inactivation using cytosine base editor." International HBV meeting (2021) pp. 1-21.

Stone, et al., "CRISPR-Cas9 gene editing of hepatitis B virus in chronically infected humanized mice." Molecular Therapy 20:258-275 (2021).

Tycko et al., (2019) "Mitigation of off-target toxicity in CRISPR-Cas9 screens for essential non-coding elements," 10(1):4063, pp. 1-14.

Zhou et al., (2022) "Efficient silencing of hepatitis B virus S gene through CRISPR-mediated based editing," Hepatology Communications, 6:1652-1663.

Kazusa, (Jul. 6, 2019). "Homo sapiens [gbpri]: 93487 CD's (40662582 codons)," available online at <https://www.kazusa.or.jp/codon/cgibin/showcodon.cgi?species=9606&aa=1&style=GCG >, accessed Sep. 11, 2024, 2 pages.

(56) References Cited

OTHER PUBLICATIONS

Genbank, (2020). "NCBI Reference Sequence: NP_056209.2; zinc finger protein 10 [Homo sapiens]," available online at <https://www.ncbi.nlm.nih.gov/protein/21314662?sat=48&satkey=118744081>, 4 pages.

* cited by examiner

FIG. 11

| Target sequence | HBV Location | cccDNA (D5) | Hep3B Int (D5) | Hep3B Int (D80) | HBV conserv % 0 MM (+1-2 MM) |
|---|---|---|---|---|---|
| HBVg_22 | 1283 | 93.0 | 89.4 | 77.0 | 92.1 (98.3) |
| HBVg_185 | 341 | 85.5 | 90.5 | 87.2 | 67.2 (70.9) |
| HBVg_23 | 340 | 86.4 | 91.5 | 79.4 | 66.9 (70.3) |
| HBVg_182 | 349 | 89.7 | 85.9 | 82.3 | 38.0 (70.5) |
| HBVg_82 | 489 | 86.0 | 86.9 | 87.1 | 55.1 (95.8) |
| HBVg_143 | 3065 | 87.8 | 86.6 | 89.4 | 30.7 (86.2) |
| HBVg_63 | 1288 | 87.0 | 93.8 | 81.0 | 54.7 (94.5) |
| HBVg_26 | 55 | 83.0 | 89.4 | 85.6 | 90.3 (91.5) |

HBs / CpG Island 1

HBx / Enh1 / CpG Island 2

| Target sequence | HBV Target Location | cccDNA Repression (D14) | Int HBV Repression (D168) | HBV conserv % 0 MM (+1/2 MM, Cas9-tolerable) |
|---|---|---|---|---|
| HBVg_22 | HBx / EN1 | 90.8% | 74.0 % | 92.1 (98.3) |
| HBVg_63 | HBx / EN1 | 91.1% | 85.7 % | 54.7 (94.5) |
| HBVg_185 | HBs | 88.7% | 88.9% | 67.2 (70.9) |
| HBVg_99 | BCP | 86.1% | 82.5% | 51.6 (96.0) |

| Target sequence | Fold Change in Metric (Post-Dose / Pre-Dose) | |
|---|---|---|
| | HBsAg | HBeAg |
| Non-targeting gRNA #1 (nt1) | -15% | -28% |
| HBVg_22 | -49%*** | -39% |
| HBVg185 | +47% | -44% |
| HBVg_22 + HBVg_185 | -31%** | -37% |
| KRAB + nt1 | +32% | -27% |
| KRAB + HBVg_22 | -60%* | -64% |

Paired t-test
* = p <0.05
** = p <0.01
*** = p <0.001

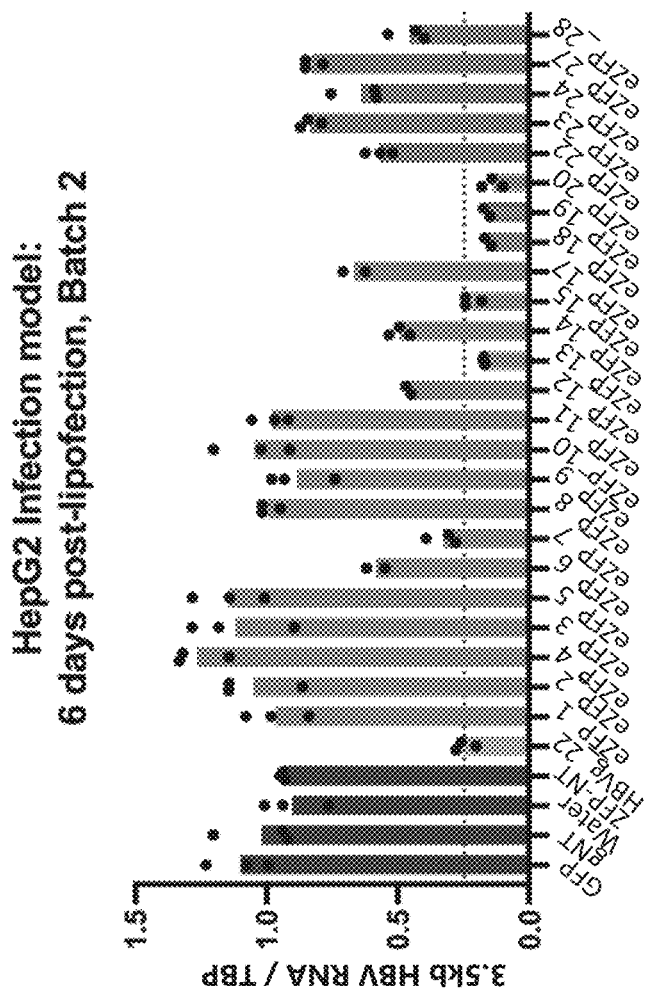
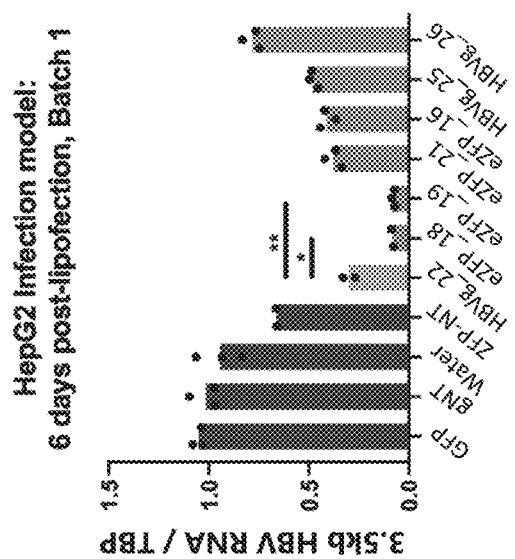
FIG. 32B
FIG. 32A

COMPOSITIONS, SYSTEMS, AND METHODS FOR REGULATION OF HEPATITIS B VIRUS THROUGH TARGETED GENE REPRESSION

CROSS-REFERENCE TO RELATED APPLICATIONS

This application claims priority from U.S. provisional application No. 63/399,634 filed Aug. 19, 2022, entitled, "COMPOSITIONS, SYSTEMS, AND METHODS FOR REGULATION OF HEPATITIS B VIRUS THROUGH TARGETED GENE REPRESSION", U.S. provisional application No. 63/472,236 filed Jun. 9, 2023, entitled, "COMPOSITIONS, SYSTEMS, AND METHODS FOR REGULATION OF HEPATITIS B VIRUS THROUGH TARGETED GENE REPRESSION", and U.S. provisional application No. 63/531,309 filed Aug. 7, 2023, entitled, "COMPOSITIONS, SYSTEMS, AND METHODS FOR REGULATION OF HEPATITIS B VIRUS THROUGH TARGETED GENE REPRESSION", the contents of which are incorporated by reference in their entireties.

INCORPORATION BY REFERENCE OF SEQUENCE LISTING

The present application is being filed along with a Sequence Listing in electronic format. The Sequence Listing is provided as a file entitled 224742002000SubSeqList.xml, created Aug. 22, 2024, which is 1,586,154 bytes in size. The information in the electronic format of the Sequence Listing is incorporated by reference in its entirety.

FIELD

The present disclosure relates in some aspects to epigenetic-modifying DNA-targeting systems, such as CRISPR-Cas/guide RNA (gRNA) systems, for the transcriptional repression of Hepatitis B viral (HBV) genes to promote a cellular phenotype that leads to the reduction of HBV infection. In some embodiments, the epigenetic-modifying DNA-targeting systems bind to or target a target site of at least one gene or regulatory element thereof in a Hepatitis B viral DNA sequence in cell. In some embodiments, the systems are multiplexed systems that bind to or target a target site in at least two genes or regulatory elements thereof. In some aspects, the systems of the present disclosure relate to the transcriptional repression of one or more Hepatitis B viral gene. In some aspects, the present disclosure is directed to methods and uses related to the provided compositions, for example in repressing Hepatitis B viral replication and expression in connection with treatments for Hepatitis B infections.

BACKGROUND

A large patient population, estimated at one million individuals in the US alone, and 250 million worldwide, deals with chronic Hepatitis B infection. However, current standard of care, including suppression of viral DNA transcription such as administration of nucleoside analogs, PEGylated interferon, anti-sense oligonucleotide, and siRNA approaches face challenges in efficacy and stability. Therefore, there is a need for new and improved methods to overcome these challenges. The present disclosure addresses these and other needs.

SUMMARY

Provided herein is an epigenetic-modifying DNA-targeting system comprising at least one DNA-targeting module for repressing transcription of one or more Hepatitis B viral (HBV) genes, wherein each of the at least one DNA-targeting module comprises a fusion protein comprising: (a) a DNA-binding domain for targeting to a target site in a Hepatitis B viral DNA sequence; and (b) at least one transcriptional repressor effector domain. In some embodiments, the at least one DNA-binding domain comprises a Clustered Regularly Interspaced Short Palindromic Repeats associated (Cas)-guide RNA (gRNA) combination comprising (a) a Cas protein or a variant thereof and (b) at least one gRNA; a zinc finger protein (ZFP); a transcription activator-like effector (TALE); a meganuclease; a homing endonuclease; or an I-SceI enzyme or a variant thereof, optionally wherein the DNA-binding domain comprises a catalytically inactive variant of any of the foregoing. In some embodiments, the Hepatitis B viral DNA sequence is an HBV gene or a regulatory element thereof. In some embodiments, the at least one DNA-targeting module comprises a plurality of DNA-targeting modules for targeting a plurality of target sites of one or a plurality of genes or regulatory elements thereof. In some embodiments, the plurality of DNA-targeting modules comprise at least a first DNA-targeting module and a second DNA-targeting module, wherein: (1) the first DNA-targeting module represses transcription of a first HBV gene, wherein the first DNA-targeting module comprises a first fusion protein comprising (a) a DNA-binding domain for targeting a target site of the first gene or regulatory DNA element thereof; and (b) at least one transcriptional repressor domain; and (2) the second DNA-targeting module represses transcription of a second HBV gene, wherein the second DNA-targeting module comprises a second fusion protein comprising (a) a DNA-binding domain for targeting a target site of the second gene or regulatory DNA element thereof; and (b) at least one transcriptional repressor domain, optionally wherein: the first DNA-targeting module and the second DNA-targeting module share the same fusion protein such that the first and second fusion protein are the same, and wherein the DNA-binding domain of the fusion protein is a Clustered Regularly Interspaced Short Palindromic Repeats associated (Cas) protein or variant thereof; and the first DNA-targeting module comprises a first guide RNA (gRNA) that targets a target site of a first HBV gene or regulatory element thereof, and the second DNA-targeting module comprises a second gRNA that targets a target site of a second HBV gene or regulatory element thereof.

Also provided herein is an epigenetic-modifying DNA-targeting system for repressing transcription of one or more Hepatitis B viral (HBV) genes, wherein the DNA-targeting system comprises: (a) a fusion protein comprising a Clustered Regularly Interspaced Short Palindromic Repeats associated (Cas) protein or variant thereof and at least one transcriptional repressor effector domain; and (b) a plurality of guide RNAs (gRNAs) comprising at least a first gRNA and a second gRNA, wherein the first gRNA targets a target site of a first HBV gene or regulatory element thereof, and the second gRNA targets a target site of a second HBV gene or regulatory element thereof, wherein the first and second genes or regulatory elements thereof regulate Hepatitis B virus replication and/or HBV transcription. In some embodiments, the DNA-targeting system further comprises a third gRNA that targets a target site of a third gene or regulatory element thereof that regulates Hepatitis B virus replication and/or HBV transcription. In some embodiments, the system further comprises a fourth gRNA that targets a target site of a fourth gene or regulatory element thereof, optionally a fifth gRNA that targets a fifth gene or regulatory element thereof, and/or optionally a sixth gRNA that targets a target site of a sixth gene or regulatory element thereof, wherein the genes or regulatory element thereof regulate Hepatitis B virus replication and/or HBV transcription. In some embodiments, the first, second, third, fourth, fifth, and/or sixth genes or regulatory elements thereof are different.

Also provided herein is an epigenetic-modifying DNA-targeting system for repressing transcription of one or more Hepatitis B viral (HBV) genes, wherein the DNA-targeting system comprises: (a) a fusion protein comprising a Clustered Regularly Interspaced Short Palindromic Repeats associated (Cas) protein or variant thereof and at least one transcriptional repressor effector domain; and (b) a plurality of guide RNAs (gRNAs) targeting a plurality of target sites of a plurality of genes or regulatory elements thereof, wherein the plurality of genes or regulatory elements thereof regulate Hepatitis B virus replication and/or HBV transcription.

Also provided herein is an epigenetic-modifying DNA-targeting system comprising a single DNA-targeting module for repressing transcription of more than one Hepatitis B viral (HBV) genes, wherein the DNA-targeting module comprises: (a) a fusion protein comprising a Clustered Regularly Interspaced Short Palindromic Repeats associated (Cas) protein or variant thereof and at least one transcriptional repressor effector domain; and (b) a guide RNAs (gRNA) targeting a plurality of target sites of a plurality of genes or regulatory elements thereof, wherein the plurality of genes or regulatory elements thereof regulate Hepatitis B virus replication and/or HBV transcription.

In any of the embodiments herein, repressing transcription results in reduced HBV replication and/or reduced HBV protein levels.

In any of the embodiments herein, the DNA-targeting system does not introduce a genetic disruption or a DNA break.

In any of the embodiments herein, the at least one DNA-binding module comprises a plurality of DNA-binding modules that together target a plurality of target sites in the HBV DNA sequence, optionally wherein each DNA-binding module targets a different target site in the HBV DNA sequence.

In any of the embodiments herein, the plurality of target sites are 2, 3, 4, 5, or 6 different target sites. In any of the embodiments herein, the plurality of target sites are each in a different HBV gene or a regulatory element thereof.

In any of the embodiments herein, each target site is in the same HBV gene or a regulatory element thereof.

In any of the embodiments herein, the system comprises 2 to 10 DNA-targeting modules.

In any of the embodiments herein, any two or more of the DNA-targeting modules share the same fusion protein or wherein any two or more of the DNA-targeting modules comprise different fusion proteins.

In any of the embodiments herein, the DNA-binding domain of each DNA-targeting module comprises a fusion protein comprising a Clustered Regularly Interspaced Short Palindromic Repeats associated (Cas) protein or variant thereof and at least one transcriptional repressor effector domain and wherein each DNA-targeting module comprises a unique gRNA.

In any of the embodiments herein, the target site, or each of the target sites, is present in a covalently closed circular DNA (cccDNA) form, relaxed circular DNA (rcDNA) form and/or is in HBV viral DNA integrated in the human genomic DNA. In any of the embodiments herein, the target site, or each of the target sites, is present at or near a gene or a regulatory element thereof involved in controlling HBV replication and/or HBV transcription.

In any of the embodiments herein, the gene involved in controlling HBV replication and/or HBV transcription encodes a polymerase, an envelope protein, capsid protein, transcription factor, or transcriptional transactivator. In any of the embodiments herein, the gene involved in controlling HBV replication and/or HBV transcription is a polymerase gene, S-family gene, X-gene, or core family gene.

In any of the embodiments herein, at least one target site is in gene or regulatory element thereof of the X-gene encoding Hepatitis B Virus Protein X (HBx).

In any of the embodiments herein, the target site, or each of the target sites, is at or near a regulatory element of the HBV gene involved in controlling HBV replication and/or HBV transcription. In some embodiments, the regulatory element is a promoter region. In some embodiments, the promoter region is a pre-S1 promoter, a pre-S2 promoter, X promoter, or basal core promoter. In some embodiments, the regulatory element is an enhancer region. In some embodiments, the enhancer region is an Enh1 or an Enh2 enhancer region. In some embodiments, the regulatory element is a transcript processing control region.

In any of the embodiments herein, the target site, or each of the target sites, is in a coding region of an HBV gene. In any of the embodiments herein, the target site, or each of the target sites, is located within 500 base pairs (bp), within 1000 bp, within 1500 bp of a transcription start site. In any of the embodiments herein, the target site, or each of the target sites, is positioned within a target region that is located at base pairs between 0-3300 base pairs (bp) of the HBV genome, optionally between 0-3182 bp corresponding to positions with reference to the HBV genome set forth in SEQ ID NO: 650. In any of the embodiments herein, the target site, or each of the target sites, is positioned within a target region that is located at base pairs between 43 bp-490 bp, 1033 bp-1749 bp, 1800 bp-1950 bp, or 2953 bp-3182 bp of the HBV genome corresponding to positions with reference to the HBV genome set forth in SEQ ID NO: 650. In any of the embodiments herein, the target site, or each of the target sites, is positioned within a target region that is located at base pairs between 1 bp-42 bp, 491 bp-1032 bp, 1750 bp-1799 bp, or 1951 bp-2952 bp of the HBV genome corresponding to positions with reference to the HBV genome set forth in SEQ ID NO: 650. In any of the embodiments herein, the target site, or each of the target sites, is in a CpG island of the HBV genome. In any of the embodiments herein, the target site, or each of the target sites, is positioned within a target region that is located at base pairs between 67 bp-392 bp, 1033 bp-1749 bp, or 2215 bp-2490 bp of the HBV genome corresponding to positions with reference to the HBV genome set forth in SEQ ID NO: 650. In any of the embodiments herein, the target site, or each of the target sites, is positioned within a target region that is located at base pairs between 1033 bp-1749 bp in a Hepatitis B viral sequence with reference to nucleotide positions of SEQ ID NO: 650. In any of the embodiments herein, the target site, or each of the target sites, is within a target region located within 300 base pairs upstream of the hepatitis B X protein (HBx) start codon.

Also provided herein is an epigenetic-modifying DNA-targeting system comprising at least one DNA-targeting module for repressing transcription of one or more Hepatitis B viral (HBV) genes, wherein each of the at least one DNA-targeting module comprises a fusion protein comprising: (a) a DNA-binding domain for targeting to a target site within a target region spanning within 300 base pairs upstream of the hepatitis B X protein (HBx) start codon; and (b) at least one transcriptional repressor effector domain.

In any of the embodiments herein, the target site, or each of the target sites, is positioned in the HBx basal core promoter region. In any of the embodiments herein, the target site, or each of the target sites, is positioned within the HBx promoter/Enhancer region.

In any of the embodiments herein, the target site, or each of the target sites, is within a target region spanning within 250 base pairs upstream of the hepatitis B X protein (HBx) start codon. In any of the embodiments herein, the target site, or each of the target sites, is within a target region having a sequence corresponding to the sequence located at base pairs between 1060-1480 bp of the HBV genome with reference to the HBV genome set forth in SEQ ID NO: 650. In any of the embodiments herein, the target site, or each of the target sites, is within a target region spanning within 150 base pairs upstream of the hepatitis B X protein (HBx) start codon. In any of the embodiments herein, the target site, or each of the target sites, is within a target region spanning within 120 base pairs upstream of the hepatitis B X protein (HBx) start codon. In any of the embodiments herein, the target site, or each of the target sites, is within a target region sequence corresponding to the sequence spanning 1250-1374 bp of the HBV genome with reference to the HBV genome set forth in SEQ ID NO: 650. In any of the embodiments herein, the target site, or each of the target sites, is within a target region sequence corresponding to the sequence spanning 1255-1302 bp of the HBV genome with reference to the HBV genome set forth in SEQ ID NO: 650. In any of the embodiments herein, the target site, or each of the target sites, is within a target region sequence corresponding to the sequence spanning 1260-1300 bp of the HBV genome with reference to the HBV genome set forth in SEQ ID NO: 650.

In any of the embodiments herein, the target site, or each of the target sites, is at least 70% homologous to all Hepatitis B viral genomes. In any of the embodiments herein, the target site, or each of the target sites, is at least 70% homologous to at least 1000 Hepatitis B viral genomes. In any of the embodiments herein, the target site, or each of the target sites, is at least 70% homologous to at least 1000 Hepatitis B viral genomes and comprises up to two mismatches.

In any of the embodiments herein, the target site, or each of the target sites, comprises the sequence set forth in any one of SEQ ID NOS: 1-195, a contiguous portion thereof of at least 14 nucleotides (nt), or a complementary sequence of any of the foregoing. In any of the embodiments herein, the target site, or each of the target sites comprises the sequence set forth in any one of SEQ ID NOs: 175, 138, 192, 152, 118, 125, 185, 63, 116, 124, 35, 82, a contiguous portion thereof of at least 14 nucleotides (nt), or a complementary sequence of any of the foregoing. In any of the embodiments herein, the target site, or each of the target sites comprises the sequence set forth in any one of SEQ ID NOs: 175, 138, 192, 152, 118, 125, 185, 63, 116, 124, 35, 82. In any of the embodiments herein, the target site, or each of the target sites comprises the sequence set forth in any one of SEQ ID NOs: 5, 6, 12, 18, 22, 26, 29, 38, 42, 43, 51, 56, 61, 63, 68, 72, 75, 79, 82, 84, 88, 89, 98, 99, 113, 116, 121, 124, 125, 118, 130, 133, 135, 138, 143, 150, 152, 155, 158, 164, 165, 175, 176, 182, 185, 189, 190, 192, a contiguous portion thereof of at least 14 nucleotides (nt), or a complementary sequence of any of the foregoing. In any of the embodiments herein, the target site, or each of the target sites comprises the sequence set forth in any one of SEQ ID NOs: 5, 6, 12, 18, 22, 26, 29, 38, 42, 43, 51, 56, 61, 63, 68, 72, 75, 79, 82, 84, 88, 89, 98, 99, 113, 116, 121, 124, 125, 118, 130, 133, 135, 138, 143, 150, 152, 155, 158, 164, 165, 175, 176, 182, 185, 189, 190, 192. In any of the embodiments herein, the target site, or each of the target sites, is set forth in any one of SEQ ID NOS: 12, 18, 20, 22, 26, 27, 46, 50, 63, 66, 73, 79, 185, 192, a contiguous portion thereof of at least 14 nucleotides, or a complementary sequence of any of the foregoing. In any of the embodiments herein, the target site, or each of the target sites, is set forth in any one of SEQ ID NOS: 12, 18, 20, 22, 26, 27, 46, 50, 63, 66, 73, 79, 185, 192. In any of the embodiments herein, the target site, or each of the target sites, comprises the sequence set forth in SEQ ID NO: 22, a contiguous portion thereof of at least 14 nucleotides, or a complementary sequence of any of the foregoing, optionally wherein the target site is set forth in SEQ ID NO: 22. In any of the embodiments herein, the target site, or each of the target sites, comprises the sequence set forth in SEQ ID NO: 63, a contiguous portion thereof of at least 14 nucleotides, or a complementary sequence of any of the foregoing, optionally wherein the target site is set forth in SEQ ID NO: 63.

In any of the embodiments herein, the gRNA, or each of the gRNA, comprises a gRNA spacer sequence comprising the sequence set forth in any one of SEQ ID NOs: 196-390. In any of the embodiments herein, the gRNA, or each of the gRNA further comprises the sequence set forth in SEQ ID NO: 587. In any of the embodiments herein, the gRNA, or each of the gRNA, comprises the sequence set forth in any one of SEQ ID NOS: 196-390. In any of the embodiments herein, the gRNA, or each of the gRNA, is set forth in any one of SEQ ID NOS: 391-585. In any of the embodiments herein, the gRNA, or each of the gRNA, comprises the sequence set forth in any one of SEQ ID NOS: 370, 333, 387, 347, 313, 320, 380, 256, 258, 311, 319, 230, 272, a contiguous portion thereof of at least 14 nucleotides, or a complementary sequence of any of the foregoing, optionally wherein the gRNA, or each of the gRNA, is set forth in any one of SEQ ID NOS: 565, 528, 542, 508, 515, 575, 515, 453, 506, 514, 425, or 472. In any of the embodiments herein, the gRNA, or each of the gRNA, comprises the sequence set forth in any one of SEQ ID NOS: 370, 333, 387, 347, 313, 320, 380, 256, 258, 311, 319, 230, 272, optionally wherein the gRNA, or each of the gRNA, is set forth in any one of SEQ ID NOS: 565, 528, 542, 508, 515, 575, 515, 453, 506, 514, 425, or 472. In any of the embodiments herein, the gRNA, or each of the gRNA, comprises the sequence set forth in any one of SEQ ID NOS: 200, 201, 207, 217, 221, 224, 233, 237, 238, 246, 251, 256, 258, 263, 267, 274, 270, 277, 279, 283, 284, 293, 294, 308, 311, 313, 316, 319, 320, 325, 328, 330, 333, 338, 345, 347, 350, 353, 359, 360, 370, 371, 377, 380, 384, 385, 387, a contiguous portion thereof of at least 14 nucleotides, or a complementary sequence of any of the foregoing, optionally wherein the gRNA, or each of the gRNA, is set forth in any one of SEQ ID NOS: 369, 395, 402, 408, 412, 416, 419, 428, 432, 433, 441, 446, 451, 453, 458, 462, 465, 469, 472, 474, 478, 479, 488, 489, 503, 506, 508, 511, 514, 515, 520, 523, 525, 575, 528, 533, 540, 542, 545, 548, 554, 555, 565, 566, 572, 579, 580, or 582. In any of the embodiments herein, the gRNA, or each of the gRNA, comprises the sequence set forth in any one of SEQ ID NOS: 200, 201, 207, 217, 221, 224, 233, 237, 238, 246, 251, 256, 258, 263, 267, 274, 270, 277, 279, 283, 284, 293, 294, 308, 311, 313, 316, 319, 320, 325, 328, 330, 333, 338, 345, 347, 350, 353, 359, 360, 370, 371, 377, 380, 384, 385, or 387, optionally wherein the gRNA, or each of the gRNA, is set forth in any one of SEQ ID NOS: 369, 395, 402, 408, 412, 416, 419, 428, 432, 433, 441, 446, 451, 453, 458, 462, 465, 469, 472, 474, 478, 479, 488, 489, 503, 506, 508, 511, 514, 515, 520, 523, 525, 575, 528, 533, 540, 542, 545, 548, 554, 555, 565, 566, 572, 579, 580, or 582. In any of the embodiments herein, the gRNA, or each of the gRNA, comprises the sequence set forth in any one of SEQ ID NOS: 207, 213, 215, 217, 221, 222, 241, 245, 258, 261, 268, 274, 380, 387, a contiguous portion thereof of at least 14 nucleotides, or a complementary sequence of any of the foregoing, optionally wherein the gRNA, or each of the gRNA, is set forth in any one of SEQ ID NOS: 402, 408, 410, 412, 416, 417, 436, 440, 453, 456, 463, 469, 575, 582. In any of the embodiments herein, the gRNA, or each of the gRNA, comprises the sequence set forth in any one of SEQ ID NOS: 207, 213, 215, 217, 221, 222, 241, 245, 258, 261, 268, 274, 380, 387. In any of the embodiments herein, the gRNA, or each of the gRNA, is set forth in any one of SEQ ID NOS: 402, 408, 410, 412, 416, 417, 436, 440, 453, 456, 463, 469, 575, 582. In any of the embodiments herein, the gRNA, or each of the gRNA, comprises the sequence set forth in SEQ ID NO: 217, a contiguous portion thereof of at least 14 nucleotides, or a complementary sequence of any of the foregoing. In any of the embodiments herein, the gRNA, or each of the gRNA, comprises the sequence set forth in SEQ ID NO: 217. In any of the embodiments herein, the gRNA, or each of the gRNA, is set forth in any one of SEQ ID NO: 412. In any of the embodiments herein, the gRNA, or each of the gRNA, comprises the sequence set forth in SEQ ID NO: 258, a contiguous portion thereof of at least 14 nucleotides, or a complementary sequence of any of the foregoing. In any of the embodiments herein, the gRNA, or each of the gRNA, comprises the sequence set forth in SEQ ID NO: 258. In any of the embodiments herein, the gRNA, or each of the gRNA, is set forth in any one of SEQ ID NO: 453.

In any of the embodiments herein, the target site, or each of the target sites, is at least 90% homologous to all Hepatitis B viral genomes. In any of the embodiments herein, the target site, or each of the target sites, is at least 90% homologous to at least 1000 Hepatitis B viral genomes. In any of the embodiments herein, the target site, or each of the target sites, is at least 90% homologous to at least 1000 Hepatitis B viral genomes and comprises up to two mismatches, optionally one or two mismatches.

In any of the embodiments herein, the target site, or each of the target sites, comprises a sequence set forth in any one of SEQ ID NOS: 35-100, a contiguous portion thereof of at least 14 nucleotides (nt), or a complementary sequence of any of the foregoing.

In any of the embodiments herein, the gRNA, or each of the gRNA, comprises a gRNA spacer sequence comprising the sequence set forth in any one of SEQ ID NOs: 230-295. In any of the embodiments herein, the gRNA, or each of the gRNA, further comprises the sequence set forth in SEQ ID NO: 587. In any of the embodiments herein, the gRNA, or each of the gRNA, comprises the sequence set forth in any one of SEQ ID NOs: 230-295, optionally wherein the gRNA or each of the gRNA is set forth in any one of SEQ ID NOs: 425-490.

In any of the embodiments herein, the up to two mismatches are located in the first 12 nt on the 5' end of the protospacer.

In any of the embodiments herein, the target site, or each of the target sites, is at least 90% homology to at least 1000 Hepatitis B viral genomes and comprises zero mismatches.

In any of the embodiments herein, the target site comprises the sequence set forth in any one of SEQ ID NOS: 1-34, a contiguous portion thereof of at least 14 nucleotides (nt), or a complementary sequence of any of the foregoing.

In any of the embodiments herein, the gRNA, or each of the gRNA, comprises a gRNA spacer sequence comprising the sequence set forth in SEQ ID NO: 196-229.

In any of the embodiments herein, the gRNA spacer sequence is between 14 nt and 24 nt, or between 16 nt and 22 nt in length. In any of the embodiments herein, the gRNA spacer sequence is 18 nt, 19 nt, 20 nt, 21 nt or 22 nt in length.

In any of the embodiments herein, the gRNA spacer sequence comprises modified nucleotides for increased stability.

In any of the embodiments herein, the at least one gRNA further comprises the sequence set forth in SEQ ID NO: 587. In any of the embodiments herein, the gRNA, or each of the gRNA, comprises the sequence set forth in any one of SEQ ID NOS: 196-229, optionally wherein the gRNA, or each of the gRNA, is set forth in any one of SEQ ID NOS: 391-424. In any of the embodiments herein, the gRNA, or each of the gRNA, comprises the sequence set forth in any one of SEQ ID NOS: 207, 213, 215, 217, 221, 222, 241, 245, 258, 261, 268, 274, 380, 387, optionally wherein the gRNA, or each of the gRNA, is set forth in any one of SEQ ID NOS: 402, 408, 410, 412, 416, 417, 436, 440, 453, 456, 463, 469, 575, 582. In any of the embodiments herein, the gRNA comprises the sequence set forth in SEQ ID NO: 217, optionally wherein the gRNA, is set forth in SEQ ID NO: 412.

In any of the embodiments herein, the Cas protein or a variant thereof is a Cas9 protein or a variant thereof. In any of the embodiments herein, the Cas protein or a variant thereof is a Cas12 protein or a variant thereof. In any of the embodiments herein, the Cas protein or a variant thereof is a variant Cas protein, wherein the variant Cas protein lacks nuclease activity or is a deactivated Cas (dCas) protein. In any of the embodiments herein, the variant Cas protein is a variant Cas9 protein that lacks nuclease activity or that is a deactivated Cas9 (dCas9) protein. In any of the embodiments herein, the Cas9 protein or a variant thereof is a *Staphylococcus aureus* Cas9 (SaCas9) protein or a variant thereof. In any of the embodiments herein, the variant Cas9 is a *Staphylococcus aureus* dCas9 protein (dSaCas9) that comprises at least one amino acid mutation selected from D10A and N580A, with reference to numbering of positions of SEQ ID NO: 596. In any of the embodiments herein, the variant Cas9 protein comprises the sequence set forth in SEQ ID NO: 597, or an amino acid sequence that has at least 90%, 91%, 92%, 93%, 94%, 95%, 96%, 97%, 98%, or 99% sequence identity to SEQ ID NO: 597. In any of the embodiments herein, the Cas9 protein or a variant thereof is a *Streptococcus pyogenes* Cas9 (SpCas9) protein or a variant thereof. In any of the embodiments herein, the variant Cas9 is a *Streptococcus pyogenes* dCas9 (dSpCas9) protein that comprises at least one amino acid mutation selected from D10A and H840A, with reference to numbering of positions of SEQ ID NO: 598. In any of the embodiments herein, the variant Cas9 protein comprises the sequence set forth in SEQ ID NO:599 or an amino acid sequence that has at least 90%, 91%, 92%, 93%, 94%, 95%, 96%, 97%, 98%, or 99% sequence identity thereto.

In any of the embodiments herein, the at least one DNA-binding domain comprises an engineered zinc finger protein (eZFP). In any of the embodiments herein, the at least one DNA-binding domain is an eZFP. In any of the embodiments herein, the target site comprises the nucleotide sequence set forth in any one of SEQ ID NOS: 1045, 1046, 1052, a contiguous portion thereof of at least 12 nt, or a complementary sequence of any of the foregoing. In any of the embodiments herein, the target site comprises the nucleotide sequence set forth in any one of SEQ ID NOS: 1045, 1046, 1052.

In any of the embodiments herein, the zinc finger protein comprises six zinc fingers denoted F1 through F6 in order from N-terminus to C-terminus, and wherein the amino acid sequence of each zinc finger recognition region is as follows: 1) F1:SEADRSR(SEQ ID NO:720) F2:DRSNLTR(SEQ ID NO:721) F3:QSSDLSR(SEQ ID NO:722) F4:YHWYLKK(SEQ ID NO:723) F5:RSDSLSV(SEQ ID NO:724) F6:QNANRKT(SEQ ID NO:725); 2) F1:RSDVLST(SEQ ID NO:726) F2:DNSSRTR(SEQ ID NO:727) F3:RPYTLRL(SEQ ID NO:728) F4:DSSHRTR(SEQ ID NO:729) F5:RSDHLSQ(SEQ ID NO:730) F6:DSSHRTR(SEQ ID NO:731); 3) F1:RSDHLSQ(SEQ ID NO:732) F2:QSADRTK(SEQ ID NO:733) F3:RSDHLSQ(SEQ ID NO:734) F4:RRSDLKR(SEQ ID NO:735) F5:RSDHLSR(SEQ ID NO:736) F6:QSSDLRR(SEQ ID NO:737); 4) F1:RSDNLSE(SEQ ID NO:738) F2:TSSNRKT(SEQ ID NO:739) F3:DRSHLTR(SEQ ID NO:740) F4:RSDALTQ(SEQ ID NO:741) F5:DRSALAR(SEQ ID NO:742) F6:RRFTLSK(SEQ ID NO:743); 5) F1:RSDHLSE(SEQ ID NO:744) F2:QYSGRYY(SEQ ID NO:745) F3:HGQTLNE(SEQ ID NO:746) F4:QSGNLAR(SEQ ID NO:747) F5:RSDSLLR(SEQ ID NO:748) F6:CREYRGK(SEQ ID NO:749); 6) F1:QSANRTT(SEQ ID NO:750) F2:RSANLTR(SEQ ID NO:751) F3:RSDVLSE(SEQ ID NO:752) F4:TSGHLSR(SEQ ID NO:753) F5:QSSDLSR(SEQ ID NO:754), F6:QWSTRKR(SEQ ID NO:755); 7) F1:QSGNLAR(SEQ ID NO:756) F2:ATCCLAH(SEQ ID NO:757) F3:RWQYLPT(SEQ ID NO:758) F4:DRSALAR(SEQ ID NO:759) F5:RSDNLSE(SEQ ID NO:760) F6:KRCNLRC(SEQ ID NO:761); 8) F1:NPANLTR(SEQ ID NO:762) F2:QNATRTK(SEQ ID NO:763) F3:QSGHLAR(SEQ ID NO:764) F4:NRHDRAK(SEQ ID NO:765) F5:RSDHLSE(SEQ ID NO:766), F6:QRRSRYK(SEQ ID NO:767); 9) F1:QSSDLSR(SEQ ID NO:768) F2:HRSTRNR(SEQ ID NO:769) F3:RSDVLSA(SEQ ID NO:770) F4:DSRTRKN(SEQ ID NO:771) F5:QSGSLTR(SEQ ID NO:772) F6:DQSGLAH(SEQ ID NO:773); 10) F1:QNPAQWR(SEQ ID NO:774) F2:RSADLSR(SEQ ID NO:775) F3:TSGSLSR(SEQ ID NO:776) F4:RSDHLSR(SEQ ID NO:777) F5:RSDSLLR(SEQ ID NO:778) F6:QSYDRFQ(SEQ ID NO:779); 11) F1:TSGSLSR(SEQ ID NO:780) F2:RSDHLSR(SEQ ID NO:781) F3:RSDSLLR(SEQ ID NO:782) F4:QSYDRFQ(SEQ ID NO:783) F5:RSDNLST(SEQ ID NO:784) F6:DNRDRIK(SEQ ID NO:785); 12) F1:DRSNLSR(SEQ ID NO:786) F2:LRQNLIM(SEQ ID NO:787) F3:ERGTLAR(SEQ ID NO:788) F4:RSDALTQ(SEQ ID NO:789) F5:RSDSLSQ(SEQ ID NO:790) F6:RKADRTR(SEQ ID NO:791); 13) F1:QYCCLTN(SEQ ID NO:792) F2:TSGNLTR(SEQ ID NO:793) F3:QSSDLSR(SEQ ID NO:794) F4:FRYYLKR(SEQ ID NO:795) F5:QSGDLTR(SEQ ID NO:796) F6:DKGNLTK(SEQ ID NO:797); 14) F1:TSGSLSR(SEQ ID NO:798) F2:RSDNLTT(SEQ ID NO:799) F3:QSGNLAR(SEQ ID NO:800) F4:DRTTLMR(SEQ ID NO:801) F5:QSGHLAR(SEQ ID NO:802) F6:QLTHLNS(SEQ ID NO:803); 15) F1:IKHDLHR(SEQ ID NO:804) F2:RSANLTR(SEQ ID NO:805) F3:RSDNLAR(SEQ ID NO:806) F4:QNVSRPR(SEQ ID NO:807) F5:RSDDLSK(SEQ ID NO:808) F6:DSSHRTR(SEQ ID NO:809); 16) F1:RSDNLAR(SEQ ID NO:810) F2:QNVSRPR(SEQ ID NO:811) F3:RSDDLSK(SEQ ID NO:812) F4:DSSHRTR(SEQ ID NO:813) F5:TSSNRKT(SEQ ID NO:814) F6:AQWTRAC(SEQ ID NO:815); 17) F1:RSDDLSK(SEQ ID NO:816) F2:DSSHRTR(SEQ ID NO:817) F3:TSSNRKT(SEQ ID NO:818) F4:AQWTRAC(SEQ ID NO:819) F5:RKQTRTT(SEQ ID NO:820) F6:HRSSLRR(SEQ ID NO:821); 18) F1:QSAHRKN(SEQ ID NO:822) F2:TSSNRKT(SEQ ID NO:823) F3:RSDNLSA(SEQ ID NO:824) F4:RNNDRKT(SEQ ID NO:825) F5:TSGSLSR(SEQ ID NO:826) F6:QAGHLAK(SEQ ID NO:827); 19) F1:RSDHLSQ(SEQ ID NO:828) F2:ASSTRTK(SEQ ID NO:829) F3:RSDDLTR(SEQ ID NO:830) F4:QKSNLSS(SEQ ID NO:831) F5:QSANRTT(SEQ ID NO:832) F6:QNATRTK(SEQ ID NO:833); 20) F1:RSDTLSE(SEQ ID NO:834) F2:RRWTLVG(SEQ ID NO:835) F3:DRSNLSR(SEQ ID NO:836) F4:QSGDLTR(SEQ ID NO:837) F5:QSSDLSR(SEQ ID NO:838) F6:YHWYLKK(SEQ ID NO:839); 21) F1:RSANLAR(SEQ ID NO:840) F2:RSDNLRE(SEQ ID NO:841) F3:RPYTLRL(SEQ ID NO:842) F4:HRSNLNK(SEQ ID NO:843) F5:QSGSLTR(SEQ ID NO:844) F6:TSANLSR(SEQ ID NO:845); 22) F1:RSDDLVR(SEQ ID NO:846) F2:TSGSLVR(SEQ ID NO:847) F3:RSDKLVR(SEQ ID NO:848) F4:RSDELVR(SEQ ID NO:849) F5:TSHSLTE(SEQ ID NO:850) F6:RADNLTE(SEQ ID NO:851); 23) F1:ERSHLRE(SEQ ID NO:852) F2:TSHSLTE(SEQ ID NO:853) F3:QAGHLAS(SEQ ID NO:854) F4:TSHSLTE(SEQ ID NO:855) F5:DPGHLVR(SEQ ID NO:856) F6:TSGNLVR(SEQ ID NO:857); 24) F1:RADNLTE(SEQ ID NO:858) F2:TSGSLVR(SEQ ID NO:859) F3:RKDNLKN(SEQ ID NO:860) F4:QSSSLVR(SEQ ID NO:861) F5:RSDKLVR(SEQ ID NO:862) F6:DSGNLRV(SEQ ID NO:863); 25) F1:QSSSLVR(SEQ ID NO:864) F2:QSGDLRR(SEQ ID NO:865) F3:RSDERKR(SEQ ID NO:866) F4:HRTTLTN(SEQ ID NO:867) F5:RSDHLTN(SEQ ID NO:868) F6:TSGELVR(SEQ ID NO:869); 26) F1:QSGDLRR(SEQ ID NO:870) F2:RSDERKR(SEQ ID NO:871) F3:HRTTLTN(SEQ ID NO:872) F4:RSDHLTN(SEQ ID NO:873) F5:TSGELVR(SEQ ID NO:874) F6:RSDDLVR(SEQ ID NO:875); 27) F1:QRAHLER(SEQ ID NO:876) F2:QLAHLRA(SEQ ID NO:877) F3:DPGHLVR(SEQ ID NO:878) F4:RRSACRR(SEQ ID NO:879) F5:RSDHLTT(SEQ ID NO:880) F6:QSSSLVR(SEQ ID NO:881); and 28) F1:QSSNLVR(SEQ ID NO:882) F2:RSDDLVR(SEQ ID NO:883) F3:THLDLIR(SEQ ID NO:884) F4:TSGNLTE(SEQ ID NO:885) F5:RRSACRR(SEQ ID NO:886) F6:RNDTLTE(SEQ ID NO:887).

In any of the embodiments herein, the zinc finger protein comprises six zinc fingers denoted F1 through F6 in order from N-terminus to C-terminus, and wherein the amino acid sequence of each zinc finger recognition region is as follows: F1:QSAHRKN(SEQ ID NO:822) F2:TSSNRKT(SEQ ID NO:823) F3:RSDNLSA(SEQ ID NO:824) F4:RNNDRKT(SEQ ID NO:825) F5:TSGSLSR(SEQ ID NO:826) F6:QAGHLAK(SEQ ID NO:827).

In any of the embodiments herein, the zinc finger protein comprises six zinc fingers denoted F1 through F6 in order from N-terminus to C-terminus, and wherein the amino acid sequence of each zinc finger recognition region is as follows:F1:RSDHLSQ(SEQ ID NO:828) F2:ASSTRTK(SEQ ID NO:829) F3:RSDDLTR(SEQ ID NO:830) F4:QKSNLSS(SEQ ID NO:831) F5:QSANRTT(SEQ ID NO:832) F6:QNATRTK(SEQ ID NO:833).

In any of the embodiments herein, the zinc finger protein comprises six zinc fingers denoted F1 through F6 in order from N-terminus to C-terminus, and wherein the amino acid sequence of each zinc finger recognition region is as follows: F1:QSSSLVR(SEQ ID NO:864) F2:QSGDLRR(SEQ ID NO:865) F3:RSDERKR(SEQ ID NO:866) F4:HRTTLTN(SEQ ID NO:867) F5:RSDHLTN(SEQ ID NO:868) F6:TSGELVR(SEQ ID NO:869).

Also provided herein is an epigenetic-modifying DNA-targeting system comprising: a) an eZFP that binds to a target site in one or more HBV genes or regulatory elements thereof and b) at least one effector domain that represses transcription of one or more HBV genes, wherein the zinc finger protein comprises six zinc fingers denoted F1 through F6 in order from N-terminus to C-terminus, and wherein the amino acid sequence of each zinc finger recognition region is as follows: 1) F1:SEADRSR(SEQ ID NO:720) F2:DRSNLTR(SEQ ID NO:721) F3:QSSDLSR(SEQ ID NO:722) F4:YHWYLKK(SEQ ID NO:723) F5:RSDSLSV(SEQ ID NO:724) F6:QNANRKT(SEQ ID NO:725); 2) F1:RSDVLST(SEQ ID NO:726) F2:DNSSRTR(SEQ ID NO:727) F3:RPYTLRL(SEQ ID NO:728) F4:DSSHRTR(SEQ ID NO:729) F5:RSDHLSQ(SEQ ID NO:730) F6:DSSHRTR(SEQ ID NO:731); 3) F1:RSDHLSQ(SEQ ID NO:732) F2:QSADRTK(SEQ ID NO:733) F3:RSDHLSQ(SEQ ID NO:734) F4:RRSDLKR(SEQ ID NO:735) F5:RSDHLSR(SEQ ID NO:736) F6:QSSDLRR(SEQ ID NO:737); 4) F1:RSDNLSE(SEQ ID NO:738) F2:TSSNRKT(SEQ ID NO:739) F3:DRSHLTR(SEQ ID NO:740) F4:RSDALTQ(SEQ ID NO:741) F5:DRSALAR(SEQ ID NO:742) F6:RRFTLSK(SEQ ID NO:743); 5) F1:RSDHLSE(SEQ ID NO:744) F2:QYSGRYY(SEQ ID NO:745) F3:HGQTLNE(SEQ ID NO:746) F4:QSGNLAR(SEQ ID NO:747) F5:RSDSLLR(SEQ ID NO:748) F6:CREYRGK(SEQ ID NO:749); 6) F1:QSANRTT(SEQ ID NO:750) F2:RSANLTR(SEQ ID NO:751) F3:RSDVLSE(SEQ ID NO:752) F4:TSGHLSR(SEQ ID NO:753) F5:QSSDLSR(SEQ ID NO:754), F6:QWSTRKR(SEQ ID NO:755); 7) F1:QSGNLAR(SEQ ID NO:756) F2:ATCCLAH(SEQ ID NO:757) F3:RWQYLPT(SEQ ID NO:758) F4:DRSALAR(SEQ ID NO:759) F5:RSDNLSE(SEQ ID NO:760) F6:KRCNLRC(SEQ ID NO:761); 8) F1:NPANLTR(SEQ ID NO:762) F2:QNATRTK(SEQ ID NO:763) F3:QSGHLAR(SEQ ID NO:764) F4:NRHDRAK(SEQ ID NO:765) F5:RSDHLSE(SEQ ID NO:766), F6:QRRSRYK(SEQ ID NO:767); 9) F1:QSSDLSR(SEQ ID NO:768) F2:HRSTRNR(SEQ ID NO:769) F3:RSDVLSA(SEQ ID NO:770) F4:DSRTRKN(SEQ ID NO:771) F5:QSGSLTR(SEQ ID NO:772) F6:DQSGLAH(SEQ ID NO:773); 10) F1:QNPAQWR(SEQ ID NO:774) F2:RSADLSR(SEQ ID NO:775) F3:TSGSLSR(SEQ ID NO:776) F4:RSDHLSR(SEQ ID NO:777) F5:RSDSLLR(SEQ ID NO:778) F6:QSYDRFQ(SEQ ID NO:779); 11) F1:TSGSLSR(SEQ ID NO:780) F2:RSDHLSR(SEQ ID NO:781) F3:RSDSLLR(SEQ ID NO:782) F4:QSYDRFQ(SEQ ID NO:783) F5:RSDNLST(SEQ ID NO:784) F6:DNRDRIK(SEQ ID NO:785); 12) F1:DRSNLSR(SEQ ID NO:786) F2:LRQNLIM(SEQ ID NO:787) F3:ERGTLAR(SEQ ID NO:788) F4:RSDALTQ(SEQ ID NO:789) F5:RSDSLSQ(SEQ ID NO:790) F6:RKADRTR(SEQ ID NO:791); 13) F1:QYCCLTN(SEQ ID NO:792) F2:TSGNLTR(SEQ ID NO:793) F3:QSSDLSR(SEQ ID NO:794) F4:FRYYLKR(SEQ ID NO:795) F5:QSGDLTR(SEQ ID NO:796) F6:DKGNLTK(SEQ ID NO:797); 14) F1:TSGSLSR(SEQ ID NO:798) F2:RSDNLTT(SEQ ID NO:799) F3:QSGNLAR(SEQ ID NO:800) F4:DRTTLMR(SEQ ID NO:801) F5:QSGHLAR(SEQ ID NO:802) F6:QLTHLNS(SEQ ID NO:803); 15) F1:IKHDLHR(SEQ ID NO:804) F2:RSANLTR(SEQ ID NO:805) F3:RSDNLAR(SEQ ID NO:806) F4:QNVSRPR(SEQ ID NO:807) F5:RSDDLSK(SEQ ID NO:808) F6:DSSHRTR(SEQ ID NO:809); 16) F1:RSDNLAR(SEQ ID NO:810) F2:QNVSRPR(SEQ ID NO:811) F3:RSDDLSK(SEQ ID NO:812) F4:DSSHRTR(SEQ ID NO:813) F5:TSSNRKT(SEQ ID NO:814) F6:AQWTRAC(SEQ ID NO:815); 17) F1:RSDDLSK(SEQ ID NO:816) F2:DSSHRTR(SEQ ID NO:817) F3:TSSNRKT(SEQ ID NO:818) F4:AQWTRAC(SEQ ID NO:819) F5:RKQTRTT(SEQ ID NO:820) F6:HRSSLRR(SEQ ID NO:821); 18) F1:QSAHRKN(SEQ ID NO:822) F2:TSSNRKT(SEQ ID NO:823) F3:RSDNLSA(SEQ ID NO:824) F4:RNNDRKT(SEQ ID NO:825) F5:TSGSLSR(SEQ ID NO:826) F6:QAGHLAK(SEQ ID NO:827); 19) F1:RSDHLSQ(SEQ ID NO:828) F2:ASSTRTK(SEQ ID NO:829) F3:RSDDLTR(SEQ ID NO:830) F4:QKSNLSS(SEQ ID NO:831) F5:QSANRTT(SEQ ID NO:832) F6:QNATRTK(SEQ ID NO:833); 20) F1:RSDTLSE(SEQ ID NO:834) F2:RRWTLVG(SEQ ID NO:835) F3:DRSNLSR(SEQ ID NO:836) F4:QSGDLTR(SEQ ID NO:837) F5:QSSDLSR(SEQ ID NO:838) F6:YHWYLKK(SEQ ID NO:839); 21) F1:RSANLAR(SEQ ID NO:840) F2:RSDNLRE(SEQ ID NO:841) F3:RPYTLRL(SEQ ID NO:842) F4:HRSNLNK(SEQ ID NO:843) F5:QSGSLTR(SEQ ID NO:844) F6:TSANLSR(SEQ ID NO:845); 22) F1:RSDDLVR(SEQ ID NO:846) F2:TSGSLVR(SEQ ID NO:847) F3:RSDKLVR(SEQ ID NO:848) F4:RSDELVR(SEQ ID NO:849) F5:TSHSLTE(SEQ ID NO:850) F6:RADNLTE(SEQ ID NO:851); 23) F1:ERSHLRE(SEQ ID NO:852) F2:TSHSLTE(SEQ ID NO:853) F3:QAGHLAS(SEQ ID NO:854) F4:TSHSLTE(SEQ ID NO:855) F5:DPGHLVR(SEQ ID NO:856) F6:TSGNLVR(SEQ ID NO:857); 24) F1:RADNLTE(SEQ ID NO:858) F2:TSGSLVR(SEQ ID NO:859) F3:RKDNLKN(SEQ ID NO:860) F4:QSSSLVR(SEQ ID NO:861) F5:RSDKLVR(SEQ ID NO:862) F6:DSGNLRV(SEQ ID NO:863); 25) F1:QSSSLVR(SEQ ID NO:864) F2:QSGDLRR(SEQ ID NO:865) F3:RSDERKR(SEQ ID NO:866) F4:HRTTLTN(SEQ ID NO:867) F5:RSDHLTN(SEQ ID NO:868) F6:TSGELVR(SEQ ID NO:869); 26) F1:QSGDLRR(SEQ ID NO:870) F2:RSDERKR(SEQ ID NO:871) F3:HRTTLTN(SEQ ID NO:872) F4:RSDHLTN(SEQ ID NO:873) F5:TSGELVR(SEQ ID NO:874) F6:RSDDLVR(SEQ ID NO:875); 27) F1:QRAHLER(SEQ ID NO:876) F2:QLAHLRA(SEQ ID NO:877) F3:DPGHLVR(SEQ ID NO:878) F4:RRSACRR(SEQ ID NO:879) F5:RSDHLTT(SEQ ID NO:880) F6:QSSSLVR(SEQ ID NO:881); and 28) F1:QSSNLVR(SEQ ID NO:882) F2:RSDDLVR(SEQ ID NO:883) F3:THLDLIR(SEQ ID NO:884) F4:TSGNLTE(SEQ ID NO:885) F5:RRSACRR(SEQ ID NO:886) F6:RNDTLTE(SEQ ID NO:887).

In any of the embodiments herein, the engineered zinc finger protein comprises the sequence set forth in any one of SEQ ID NOS: 692-719, or a portion thereof, or an amino acid sequence that has at least 90%, 91%, 92%, 93%, 94%, 95%, 96%, 97%, 98%, or 99% sequence identity thereto. In some embodiments, the engineered zinc finger protein is encoded by the sequence set forth in any one of SEQ ID NOS:888-915, or a portion thereof, or nucleotide sequence that has at least 90%, 91%, 92%, 93%, 94%, 95%, 96%, 97%, 98%, or 99% sequence identity thereto.

Also provided herein is an epigenetic-modifying DNA-targeting system comprising: a) an engineered zinc finger protein that binds to a target site in one or more HBV genes or regulatory elements thereof, and b) at least one effector domain that represses transcription of one or more HBV genes, wherein the zinc finger protein comprises six zinc fingers denoted F1 through F6 in order from N-terminus to C-terminus, and wherein the amino acid sequence of each zinc finger recognition region is as follows: F1:QSAHRKN(SEQ ID NO:822) F2:TSSNRKT(SEQ ID NO:823) F3:RSDNLSA(SEQ ID NO:824) F4:RNNDRKT(SEQ ID NO:825) F5:TSGSLSR(SEQ ID NO:826) F6:QAGHLAK(SEQ ID NO:827).

In any of the embodiments herein, the eZFP comprises the sequence set forth in SEQ ID NO: 709, or a portion thereof, or an amino acid sequence that has at least 90%, 91%, 92%, 93%, 94%, 95%, 96%, 97%, 98%, or 99% sequence identity thereto. In some embodiments, the engineered zinc finger protein comprises the sequence set forth in any one of SEQ ID NOS: 709.

In any of the embodiments herein, the engineered zinc finger protein is encoded by the sequence set forth in SEQ ID NO:905, or a portion thereof, or nucleotide sequence that has at least 90%, 91%, 92%, 93%, 94%, 95%, 96%, 97%, 98%, or 99% sequence identity thereto.In any of the embodiments herein, the engineered zinc finger protein is encoded by the sequence set forth in any one of SEQ ID NOS:905.

Also provided herein is an epigenetic-modifying DNA-targeting system comprising: a) an engineered zinc finger protein that binds to a target site in one or more HBV genes or regulatory elements thereof, and b) at least one effector domain that represses transcription of one or more HBV genes, wherein the zinc finger protein comprises six zinc fingers denoted F1 through F6 in order from N-terminus to C-terminus, and wherein the amino acid sequence of each zinc finger recognition region is as follows: F1:RSDHLSQ (SEQ ID NO:828) F2:ASSTRTK(SEQ ID NO:829) F3:RSDDLTR(SEQ ID NO:830) F4:QKSNLSS(SEQ ID NO:831) F5:QSANRTT(SEQ ID NO:832) F6:QNATRTK (SEQ ID NO:833). In some embodiments, the engineered zinc finger protein comprises the sequence set forth in SEQ ID NO: 710, or a portion thereof, or an amino acid sequence that has at least 90%, 91%, 92%, 93%, 94%, 95%, 96%, 97%, 98%, or 99% sequence identity thereto. In some embodiments, the engineered zinc finger protein comprises the sequence set forth in any one of SEQ ID NOS: 710. In any of the embodiments herein, the engineered zinc finger protein is encoded by the sequence set forth in SEQ ID NO:906, or a portion thereof, or nucleotide sequence that has at least 90%, 91%, 92%, 93%, 94%, 95%, 96%, 97%, 98%, or 99% sequence identity thereto. In any of the embodiments herein, the engineered zinc finger protein is encoded by the sequence set forth in any one of SEQ ID NOS: 906.

Also provided herein is an epigenetic-modifying DNA-targeting system comprising: a) an engineered zinc finger protein that binds to a target site in one or more HBV genes or regulatory elements thereof, and b) at least one effector domain that represses transcription of one or more HBV genes, wherein the zinc finger protein comprises six zinc fingers denoted F1 through F6 in order from N-terminus to C-terminus, and wherein the amino acid sequence of each zinc finger recognition region is as follows:F1:QSSSLVR (SEQ ID NO:864) F2:QSGDLRR(SEQ ID NO:865) F3:RSDERKR(SEQ ID NO:866) F4:HRTTLTN(SEQ ID NO:867) F5:RSDHLTN(SEQ ID NO:868) F6:TSGELVR(SEQ ID NO:869). In some embodiments, the engineered zinc finger protein comprises the sequence set forth in SEQ ID NO: 716, or a portion thereof, or an amino acid sequence that has at least 90%, 91%, 92%, 93%, 94%, 95%, 96%, 97%, 98%, or 99% sequence identity thereto. In some embodiments, the engineered zinc finger protein comprises the sequence set forth in any one of SEQ ID NOS: 716. In some embodiments, the engineered zinc finger protein is encoded by the sequence set forth in SEQ ID NO:912, or a portion thereof, or nucleotide sequence that has at least 90%, 91%, 92%, 93%, 94%, 95%, 96%, 97%, 98%, or 99% sequence identity thereto. In some embodiments, the engineered zinc finger protein is encoded by the sequence set forth in any one of SEQ ID NOS:912.

In any of the embodiments herein, the at least one effector domain induces transcription repression. In any of the embodiments herein, at least one effector domain is a DNA methyltransferase. In any of the embodiments herein, at least one effector domain comprises a DNA methyltransferase and a repressor domain capable of recruiting heterochromatin inducing factors or optionally wherein the heterochromatin inducing factors include a histone methyltransferase. In any of the embodiments herein, the at least one effector domain comprises a DNA methyltransferase and a histone methyltransferase. In any of the embodiments herein, at least one effector domain is selected from a KRAB repressor domain, ERF repressor domain, Mxi1 repressor domain, SID4X repressor domain, Mad-SID repressor domain. LSD1 repressor domain, or DNMT3A, DNMT3A-3L, DNMT3A/L-KRAB fusion repressor domain, DNMT3B domain binding protein, EZH2 repressor domain, or LSD1 repressor domain, or variant of any of the foregoing. In any of the embodiments herein, at least one effector domain comprises a sequence selected from any one of SEQ ID NOS: 590, or 600-608, 651, 661, 664, 665, 666, 668 and 669 or a domain thereof, a portion thereof, or an amino acid sequence that has at least 90%, 91%, 92%, 93%, 94%, 95%, 96%, 97%, 98%, or 99% sequence identity to any of the foregoing. In any of the embodiments herein, the at least one effector domain comprises a KRAB domain or a variant thereof. In any of the embodiments herein, the at least one effector domain comprises the sequence set forth in SEQ ID NO: 590, a portion thereof, or an amino acid sequence that has at least 90%, 91%, 92%, 93%, 94%, 95%, 96%, 97%, 98%, or 99% sequence identity to any of the foregoing. In any of the embodiments herein, the at least one effector domain comprises a DNMT3A/L domain or a variant thereof. In any of the embodiments herein, the at least one effector domain comprises the sequence set forth in SEQ ID NOS: 604 and 607, a portion thereof, or an amino acid sequence that has at least 90%, 91%, 92%, 93%, 94%, 95%, 96%, 97%, 98%, or 99% sequence identity to any of the foregoing; or the at least one effector domain comprises the sequence set forth in SEQ ID NO: 651, a portion thereof, or an amino acid sequence that has at least 90%, 91%, 92%, 93%, 94%, 95%, 96%, 97%, 98%, or 99% sequence identity to SEQ ID NO:651.

In any of the embodiments herein, the fusion protein comprises a DNMT3A/3L-dSpCas9-KRAB fusion protein. In any of the embodiments herein, the fusion protein comprises the sequence set forth in SEQ ID NO: 645 a portion thereof, or an amino acid sequence that has at least 90%, 91%, 92%, 93%, 94%, 95%, 96%, 97%, 98%, or 99% sequence identity to any of the foregoing.

In any of the embodiments herein, the at least one effector domain is fused to the N-terminus, the C-terminus, or both the N-terminus and the C-terminus, of the DNA-binding domain or a component thereof.

In any of the embodiments herein, the fusion protein is encoded by the sequence set forth in SEQ ID NO: 680, a portion thereof, or an nucleic acid sequence that has at least 90%, 91%, 92%, 93%, 94%, 95%, 96%, 97%, 98%, or 99% sequence identity to any of the foregoing. In any of the embodiments herein, the fusion protein is encoded by the sequence set forth in SEQ ID NO: 680.

In any of the embodiments herein, the fusion protein is encoded by the sequence set forth in any one of SEQ ID NOS:916-943, a portion thereof, or a nucleic acid sequence that has at least 90%, 91%, 92%, 93%, 94%, 95%, 96%, 97%, 98%, or 99% sequence identity to any of the foregoing. In any of the embodiments herein, the fusion protein comprises the sequence set forth in any one of SEQ ID NOS: 944-971, a portion thereof, or an amino acid sequence that has at least 90%, 91%, 92%, 93%, 94%, 95%, 96%, 97%, 98%, or 99% sequence identity to any of the foregoing. In any of the embodiments herein, the fusion protein comprises the sequence set forth in any one of SEQ ID NOS: 961, 962, or 968.

In any of the embodiments herein, the fusion protein comprises a DNMT3A/3L-eZFP-KRAB fusion protein.

In any of the embodiments herein, the fusion protein is encoded by the sequence set forth in any one of SEQ ID NOS:972-999, a portion thereof, or nucleic acid sequence that has at least 90%, 91%, 92%, 93%, 94%, 95%, 96%, 97%, 98%, or 99% sequence identity to any of the foregoing. In any of the embodiments herein, the fusion protein is encoded by the sequence set forth in any one of SEQ ID NOS:933, 934, or 940, a portion thereof, or a nucleic acid sequence that has at least 90%, 91%, 92%, 93%, 94%, 95%, 96%, 97%, 98%, or 99% sequence identity to any of the foregoing. In any of the embodiments herein, the fusion protein comprises the sequence set forth in any one of SEQ ID NOS:1000-1027, a portion thereof, or an amino acid sequence that has at least 90%, 91%, 92%, 93%, 94%, 95%, 96%, 97%, 98%, or 99% sequence identity to any of the foregoing. In any of the embodiments herein, the fusion protein comprises the sequence set forth in any one of SEQ ID NOS:1017, 1018, or 1024, a portion thereof, or an amino acid sequence that has at least 90%, 91%, 92%, 93%, 94%, 95%, 96%, 97%, 98%, or 99% sequence identity to any of the foregoing.

In any of the embodiments herein, the fusion protein further comprises one or more nuclear localization signals (NLS).

In any of the embodiments herein, the fusion protein further comprises one or more linkers connecting two or more of: the DNA-binding domain, the at least one effector domain, and the one or more nuclear localization signals.

In any of the embodiments herein, the DNA-targeting system targets all Hepatitis B viral genomes.

In any of the embodiments herein, the DNA-targeting system targets at least 70% of all Hepatitis B viral genomes. In any of the embodiments herein, the DNA-targeting system targets at least 60% of all Hepatitis B viral genomes. In any of the embodiments herein, the DNA-targeting system targets at least 50% of all Hepatitis B viral genomes.

In any of the embodiments herein, the DNA-targeting system is not able to introduce a genetic disruption or a DNA break at or near the target site.

In any of the embodiments herein, repressing transcription of one or more HBV genes results in a reduction in RNA levels and/or protein levels from the HBV DNA sequence. In any of the embodiments herein, repressing transcription comprises a reduction in total Hepatitis B viral RNA transcript levels. In any of the embodiments herein, repressing transcription comprises a reduction in Hepatitis B pre-core ("preC"), pre-genomic ("pgRNA"), preS1, preS2/S, and HBx levels. In any of the embodiments herein, repressing transcription comprises a reduction in HBx levels. In any of the embodiments herein, repressing transcription comprises a reduction in Hepatitis B surface antigen (HBsAg) and/or Hepatitis B viral core-related-antigen (HbcrAg) protein levels. In any of the embodiments herein, repressing transcription comprises a reduction in HbsAg transcript and/or protein levels by at least 90%. In any of the embodiments herein, repressing transcription comprises a reduction in HbcrAg transcript and/or protein levels by at least 50% from the cccDNA.

Also provided herein is a guide RNA (gRNA) that binds a target site in a Hepatitis B viral DNA sequence. In some embodiments, the Hepatitis B viral DNA sequence is Hepatitis B (HBV) gene or regulatory element thereof. In some embodiments, the target site is present in a covalently closed circular DNA (cccDNA) form, relaxed circular DNA (rcDNA) form and/or is integrated in the human genomic DNA. In any of the embodiments herein, the target site is at or near a gene or a regulatory element thereof involved in controlling HBV replication and/or HBV transcription. In any of the embodiments herein, the gene involved in controlling HBV replication and/or HBV transcription encodes a polymerase, an envelope protein, capsid protein, transcription factor, or transcriptional transactivator. In any of the embodiments herein, the gene involved in controlling HBV replication and/or HBV transcription is a polymerase gene, S-family gene, X-gene, or core-family gene. In any of the embodiments herein, the target site is in gene or regulatory element thereof of the X-gene encoding Hepatitis B Virus Protein X (HBx). In any of the embodiments herein, the target site is at or near a regulatory element involved in controlling HBV replication and/or HBV transcription.

In any of the embodiments herein, the regulatory element is a promoter region. In any of the embodiments herein, the promoter region is a pre-S1 promoter, a pre-S2 promoter, X promoter, or basal core promoter. In any of the embodiments herein, the regulatory element is an enhancer region. In any of the embodiments herein, the enhancer region is an Enh1 or an Enh2 enhancer region. In any of the embodiments herein, the regulatory element is a transcript processing control region.

In any of the embodiments herein, the target site is a coding region. In any of the embodiments herein, the target site is located within 500 bp, within 1000 bp, within 1500 bp of a transcription start site. In any of the embodiments herein, the target site is positioned within a target region that is located at base pairs between 0-3300 base pairs (bp) of the HBV genome, optionally between 0-3189 bp corresponding to positions with reference to the HBV genome set forth in SEQ ID NO: 650. In any of the embodiments herein, the target site is positioned within a target region that is located at base pairs between 43 bp-490 bp, 1033 bp-1749 bp, 1800 bp-1950 bp, or 2953 bp-3182 bp of the HBV genome corresponding to positions with reference to the HBV genome set forth in SEQ ID NO: 650. In any of the embodiments herein, the target site is positioned within a target region that is located at base pairs between 1 bp-42 bp, 491 bp-1032 bp, 1750 bp-1799 bp, or 1951 bp-2952 bp of the HBV genome corresponding to positions with reference to the HBV genome set forth in SEQ ID NO: 650.

In any of the embodiments herein, the target site, or each of the target sites, is in a CpG island of the HBV genome. In any of the embodiments herein, the target sit is positioned within a target region that is located at base pairs between 67 bp-392 bp, 1033 bp-1749 bp, or 2215 bp-2490 bp of the HBV genome corresponding to positions with reference to the HBV genome set forth in SEQ ID NO: 650. In any of the embodiments herein, the target sit is positioned within a target region that is located at base pairs between 1033 bp-1749 bp of the HBV genome corresponding to positions with reference to the HBV genome set forth in SEQ ID NO: 650. In any of the embodiments herein, the target site, or each of the target sites, is within a target region spanning within 300 base pairs upstream of the hepatitis B X protein (HBx) start codon.

Also provided herein is a gRNA (gRNA) that binds a target site within a target region spanning within 300 base pairs upstream of the hepatitis B X protein (HBx) start codon. In any of the embodiments herein, the target site is positioned in the HBx basal core promoter region. In any of the embodiments herein, the target site is positioned within the HBx promoter/Enhancer region. In any of the embodiments herein, the target site is within a target region spanning within 250 base pairs upstream of the hepatitis B X protein (HBx) start codon. In any of the embodiments herein, the target site is within a target region spanning 1060-1480 bp of the HBV genome corresponding to positions with reference to the HBV genome set forth in SEQ ID NO: 650. In any of the embodiments herein, the target site is within a target region spanning within 150 base pairs upstream of the hepatitis B X protein (HBx) start codon. In any of the embodiments herein, the target site is within a target region spanning within 120 base pairs upstream of the hepatitis B X protein (HBx) start codon. In any of the embodiments herein, the target site is within a target region sequence corresponding to the sequence spanning 1250-1374 bp of the HBV genome with reference to the HBV genome set forth in SEQ ID NO: 650. In any of the embodiments herein, the target site is within a target region sequence correcponding to the sequence spanning 1255-1302 bp of the HBV genome with reference to the HBV genome set forth in SEQ ID NO: 650. In any of the embodiments herein, the target site, is within a target region sequence corresponding to the sequence spanning 1260-1300 bp of the HBV genome with reference to the HBV genome set forth in SEQ ID NO: 650. In any of the embodiments herein, the gRNA comprises the sequence set forth in any one of SEQ ID NOS: 200, 201, 207, 217, 221, 224, 233, 237, 238, 246, 251, 256, 258, 263, 267, 274, 270, 277, 279, 283, 284, 293, 294, 308, 311, 313, 316, 319, 320, 325, 328, 330, 333, 338, 345, 347, 350, 353, 359, 360, 369, 370, 371, 377, 380, 384, 385, or 387, a contiguous portion thereof of at least 14 nucleotides, or a complementary sequence of any of the foregoing, optionally wherein the gRNA, or each of the gRNA, is set forth in any one of SEQ ID NOS: 395, 402, 408, 412, 416, 419, 428, 432, 433, 441, 446, 451, 453, 458, 462, 465, 469, 472, 474, 478, 479, 488, 489, 503, 506, 508, 511, 514, 515, 520, 523, 525, 575, 528, 533, 540, 542, 545, 548, 554, 555, 565, 566, 572, 579, 580, or 582. In any of the embodiments herein, the gRNA is set forth in any one of SEQ ID NOS: 395, 402, 408, 412, 416, 419, 428, 432, 433, 441, 446, 451, 453, 458, 462, 465, 469, 472, 474, 478, 479, 488, 489, 503, 506, 508, 511, 514, 515, 520, 523, 525, 575, 528, 533, 540, 542, 545, 548, 554, 555, 565, 566, 572, 579, 580, or 582. In any of the embodiments herein, the gRNA comprises the sequence set forth in any one of SEQ ID NOS: 207, 213, 215, 217, 221, 222, 241, 245, 258, 261, 268, 274, 380, 387, a contiguous portion thereof of at least 14 nucleotides, or a complementary sequence of any of the foregoing, optionally wherein the gRNA, or each of the gRNA, is set forth in any one of SEQ ID NOS: 402, 408, 410, 412, 416, 417, 436, 440, 453, 456, 463, 469, 575, or 582. In any of the embodiments herein, the gRNA comprises the sequence set forth in any one of SEQ ID NOS: 402, 408, 410, 412, 416, 417, 436, 440, 453, 456, 463, 469, 575, or 582. In any of the embodiments herein, the gRNA comprises the sequence set forth in SEQ ID NO: 217, a contiguous portion thereof of at least 14 nucleotides, or a complementary sequence of any of the foregoing, optionally wherein the gRNA, or each of the gRNA, is set forth in any one of SEQ ID NO: 412. In any of the embodiments herein, the gRNA comprises the sequence set forth in SEQ ID NO: 412.

Also provided herein is a CRISPR Cas-guide RNA (gRNA) combination comprising: (a) a Clustered Regularly Interspaced Short Palindromic Repeats associated (Cas) protein or variant thereof; and (b) at least one gRNA of any of claims 165-202 that targets the Cas protein or variant thereof to a target site in target site in a Hepatitis B viral DNA sequence. In some embodiments, the Cas protein or a variant thereof is a Cas9 protein or a variant thereof. In any of the embodiments herein, the Cas protein or a variant thereof is a variant Cas protein, wherein the variant Cas protein lacks nuclease activity or is a deactivated Cas (dCas) protein. In any of the embodiments herein, the variant Cas protein is a variant Cas9 protein that lacks nuclease activity or that is a deactivated Cas9 (dCas9) protein. In any of the embodiments herein, the Cas9 protein or a variant thereof is a *Staphylococcus aureus* Cas9 (SaCas9) protein or a variant thereof. In some embodiments, the variant Cas9 is a *Staphylococcus aureus* dCas9 protein (dSaCas9) that comprises at least one amino acid mutation selected from D10A and N580A, with reference to numbering of positions of SEQ ID NO: 596. In some embodiments, the variant Cas9 protein comprises the sequence set forth in SEQ ID NO: 597, or an amino acid sequence that has at least 90%, 91%, 92%, 93%, 94%, 95%, 96%, 97%, 98%, or 99% sequence identity thereto. In some embodiments, the Cas9 protein or variant thereof is a *Streptococcus pyogenes* Cas9 (SpCas9) protein or a variant thereof. In some embodiments, the variant Cas9 is a *Streptococcus pyogenes* dCas9 (dSpCas9) protein that comprises at least one amino acid mutation selected from D10A and H840A, with reference to numbering of positions of SEQ ID NO: 598. In some embodiments, the variant Cas9 protein comprises the sequence set forth in SEQ ID NO: 599, or an amino acid sequence that has at least 90%, 91%, 92%, 93%, 94%, 95%, 96%, 97%, 98%, or 99% sequence identity thereto.

Also provided is a polynucleotide encoding the epigenetic-modifying DNA-targeting system disclosed herein or a fusion protein of the DNA-targeting system disclosed herein, the gRNA disclosed herein, the CRISPR Cas-gRNA combination disclosed herein, or a portion or a component of any of the foregoing.

Also provided is a plurality of polynucleotides encoding the epigenetic-modifying DNA-targeting system disclosed herein or the fusion protein of the DNA-targeting system disclosed herein, the gRNA disclosed herein, the CRISPR Cas-gRNA combination disclosed herein, or a portion or a component of any of the foregoing.

Also provided is a vector comprising the polynucleotide disclosed herein. Also provided is a vector comprising the plurality of polynucleotides disclosed herein.

In any of the embodiments herein, the vector is a viral vector. In some embodiments herein, the vector is an adeno-associated virus (AAV) vector. In some embodiments herein, the vector is selected from among AAV1, AAV2, AAV3, AAV4, AAV5, AAV6, AAV7, AAV8, or AAV9. In some embodiments herein, the vector is a lentiviral vector. In some embodiments herein, the vector is a non-viral vector. In some embodiments herein, the non-viral vector is selected from: a lipid nanoparticle, a liposome, an exosome, or a cell penetrating peptide. In any of the embodiments herein, the vector exhibits tropism towards a Hepatitis B virus infected cell. In any of the embodiments herein, the vector comprises one vector, or two or more vectors.

Also provided herein is a method of promoting epigenetic modification within a target region in a Hepatitis B viral sequence, the method comprising introducing an epigenetic modifying DNA-targeting system that targets a target site within the target region into an HBV infected cell comprising a Hepatitis viral sequence.

Also provided herein is a method of increasing CpG methylation within a target region in a Hepatitis B viral sequence, the method comprising introducing an epigenetic modifying DNA-targeting system that targets a target site within the target region into an HBV infected cell comprising a Hepatitis viral sequence.

Also provided herein is a method of promoting epigenetic modification of a target region in a Hepatitis B viral sequence, the method comprising introducing into an HBV infected cell comprising a Hepatitis B viral sequence an epigenetic modifying DNA-targeting system disclosed herein, the gRNA disclosed herein, the CRISPR Cas-gRNA combination disclosed herein, the polynucleotide disclosed herein, the plurality of polynucleotides disclosed herein, the vector disclosed herein, or a portion or a component of any of the foregoing.

Also provided herein is a method of increasing CpG methylation of a target region in a Hepatitis B viral sequence, the method comprising introducing into an HBV infected cell comprising a Hepatitis B viral sequence an epigenetic modifying DNA-targeting system disclosed herein, the gRNA disclosed herein, the CRISPR Cas-gRNA combination disclosed herein, the polynucleotide disclosed herein, the plurality of polynucleotides disclosed herein, the vector disclosed herein, or a portion or a component of any of the foregoing.

In any of the embodiments herein, the target region comprises a contiguous sequence of nucleotides within the sequence corresponding to 1033 bp-1749 bp in a Hepatitis B viral sequence with reference to nucleotide positions of SEQ ID NO: 650.

Also provided herein is a method of reducing transcription of one or more genes in an HBV infected cell comprising a Hepatitis B viral sequence, the method comprising introducing into the cell an epigenetic-modifying DNA-targeting system that induces targeted CpG methylation within in a Hepatitis B viral sequence with reference to nucleotide positions of SEQ ID NO: 650.

Also provided herein is a method of reducing Hepatitis B virus infection in an HBV infected cell comprising introducing into a cell comprising a Hepatitis B viral sequence an epigenetic-modifying DNA-targeting system that induces targeted CpG methylation within a target region in a Hepatitis B viral sequence with reference to nucleotide positions of SEQ ID NO: 650.

In any of the embodiments herein, the epigenetic modifying DNA-targeting system comprises at least one DNA-targeting module that comprises a fusion protein comprising (a) a DNA-binding domain for targeting a target site in a Hepatitis B viral DNA sequence; and (b) at least one effector domain comprising a DNA methyltransferase effector domain.

In any of the embodiments herein, the region of CpG methylation is within 500 base pairs of the target region. In any of the embodiments herein, the introducing occurs in vivo in a subject or ex vivo.

In any of the embodiments herein, the cell is a mammalian cell. In any of the embodiments herein, the cell is a human cell. In any of the embodiments herein, the cell comprises integrated HBV DNA. In any of the embodiments herein, the cell is a hepatocyte comprising a pool of episomal HBV cccDNA. In some embodiments, the hepatocyte expresses HBV proteins, wherein the HBV proteins are HBsAg, HBeAg, or HBcrAg, or combinations of the foregoing.

Also provided herein is a method of reducing Hepatitis virus infection in a subject comprising administering to a subject infected with Hepatitis B an epigenetic modifying DNA-targeting system that increases CpG methylation within a target region in a Hepatitis B viral sequence, wherein the epigenetic modifying DNA-targeting system comprises (a) a DNA-binding domain for targeting to the target site in a Hepatitis B viral DNA sequence; and (b) at least one effector domain comprising a DNA methyltransferase effector domain.

In any of the embodiments herein, the target region is a region that comprises CpGs in the HBV genome. In any of the embodiments herein, the target region comprises a contiguous sequence of nucleotides within the sequence corresponding to 67 bp-392 bp, 1033 bp-1749 bp, or 2215 bp-2490 bp in a Hepatitis B viral sequence with reference to nucleotide positions of SEQ ID NO: 650. In any of the embodiments herein, the target region comprises a contiguous sequence of nucleotides within the sequence corresponding to 1033 bp-1749 bp in a Hepatitis B viral sequence with reference to nucleotide positions of SEQ ID NO: 650. In any of the embodiments herein, the target region is located within 300 base pairs upstream of the hepatitis B X protein (HBx) start codon. In any of the embodiments herein, the target region is within the HBx basal core promoter region. In any of the embodiments herein, the target region is within the HBx promoter/Enhancer region. In any of the embodiments herein, the target region is within 250 base pairs upstream of the hepatitis B X protein (HBx) start codon. In any of the embodiments herein, the target region comprises a contiguous sequence of nucleotides within the sequence corresponding to 1060 bp-1480 bp in a Hepatitis B viral sequence with reference to nucleotide positions of SEQ ID NO: 650. In any of the embodiments herein, the target region is within 150 base pairs upstream of the hepatitis B X protein (HBx) start codon. In any of the embodiments herein, the target region is within 120 base pairs upstream of the hepatitis B X protein (HBx) start codon. In any of the embodiments herein, the target region comprises a contiguous sequence of nucleotides within the sequence corresponding to 1250 bp-1374 bp in a Hepatitis B viral sequence with reference to nucleotide positions of SEQ ID NO: 650. In some embodiments, the target region has the sequence set forth in SEQ ID NO: 1068. In any of the embodiments herein, the target region comprises a contiguous sequence of nucleotides within the sequence corresponding to 1260 bp-1300 bp in a Hepatitis B viral sequence with reference to nucleotide positions of SEQ ID NO: 650. In some embodiments the target region has the sequence set forth in SEQ ID NO: 1070.

In any of the embodiments herein, the DNA-binding domain comprises a Clustered Regularly Interspaced Short Palindromic Repeats associated (Cas)-guide RNA (gRNA) combination comprising (a) a Cas protein or a variant thereof and (b) at least one gRNA; a zinc finger protein (ZFP); a transcription activator-like effector (TALE); a meganuclease; a homing endonuclease; or an I-SceI enzyme or a variant thereof, optionally wherein the DNA-binding domain comprises a catalytically inactive variant of any of the foregoing.

In any of the embodiments herein, the method comprises a CRISPR Cas-guide RNA (gRNA) combination comprising: (a) a Clustered Regularly Interspaced Short Palindromic Repeats associated (Cas) protein or variant thereof; and (b) at least one gRNA of any of claims 165-202 that targets the Cas protein or variant thereof to a target site in target site in a Hepatitis B viral DNA sequence.

In any of the embodiments herein, the target site, or each of the target sites comprises the sequence set forth in any one of SEQ ID NOs: 5, 6, 12, 18, 22, 26, 29, 38, 42, 43, 51, 56, 61, 63, 68, 72, 75, 79, 82, 84, 88, 89, 98, 99, 113, 116, 121, 124, 125, 118, 130, 133, 135, 138, 143, 150, 152, 155, 158, 164, 165, 175, 176, 182, 185, 189, 190, 192, a contiguous portion thereof of at least 14 nucleotides (nt), or a complementary sequence of any of the foregoing. In any of the embodiments herein, the target site, or each of the target sites comprises the sequence set forth in any one of SEQ ID NOs: 12, 18, 20, 22, 26, 27, 46, 50, 63, 66, 73, 79, 185, 192t, a contiguous portion thereof of at least 14 nucleotides (nt), or a complementary sequence of any of the foregoing. In any of the embodiments herein, the target site, or each of the target sites comprises the sequence set forth in SEQ ID NO:22, a contiguous portion thereof of at least 14 nucleotides (nt), or a complementary sequence of any of the foregoing. In any of the embodiments herein, the gRNA wherein the gRNA, or each of the gRNA, comprises the sequence set forth in any one of SEQ ID NOS: 200, 201, 207, 217, 221, 224, 233, 237, 238, 246, 251, 256, 258, 263, 267, 274, 270, 277, 279, 283, 284, 293, 294, 308, 311, 313, 316, 319, 320, 325, 328, 330, 333, 338, 345, 347, 350, 353, 359, 360, 370, 371, 377, 380, 384, 385, 387, a contiguous portion thereof of at least 14 nucleotides, or a complementary sequence of any of the foregoing, optionally wherein the gRNA, or each of the gRNA, is set forth in any one of SEQ ID NOS: 395, 402, 408, 412, 416, 419, 428, 432, 433, 441, 446, 451, 453, 458, 462, 465, 469, 472, 474, 478, 479, 488, 489, 503, 506, 508, 511, 514, 515, 520, 523, 525, 575, 528, 533, 540, 542, 545, 548, 554, 555, 565, 566, 572, 579, 580, or 582. In any of the embodiments herein, the gRNA wherein the gRNA, or each of the gRNA, comprises the sequence set forth in any one of SEQ ID NOS: 207, 213, 215, 217, 221, 222, 241, 245, 258, 261, 268, 274, 380, 387, a contiguous portion thereof of at least 14 nucleotides, or a complementary sequence of any of the foregoing, optionally wherein the gRNA, or each of the gRNA, is set forth in any one of SEQ ID NOS: 402, 408, 410, 412, 416, 417, 436, 440, 453, 456, 463, 469, 575, 582. In any of the embodiments herein, the gRNA, or each of the gRNA, comprises the sequence set forth in any one of SEQ ID NO: 217, a contiguous portion thereof of at least 14 nucleotides, or a complementary sequence of any of the foregoing, optionally wherein the gRNA, or each of the gRNA, is set forth in any one of SEQ ID NO: 412.

In any of the embodiments herein, the at least one DNA-binding domain comprises an engineered zinc finger protein (eZFP). In any of the embodiments herein, the target site comprises the nucleotide sequence set forth in any one of SEQ ID NOS: 1045, 1046, 1052, a contiguous portion thereof of at least 12 nt, or a complementary sequence of any of the foregoing. In any of the embodiments herein, the target site comprises the nucleotide sequence set forth in any one of SEQ ID NOS: 1045, 1046, 1052.

In any of the embodiments herein, at least one effector domain is a DNA methyltransferase. In any of the embodiments herein, at least one effector domain comprises a DNA methyltransferase and a repressor domain capable of recruiting heterochromatin inducing factors or optionally wherein the heterochromatin inducing factors include a histone methyltransferase. In any of the embodiments herein, the at least one effector domain comprises a DNA methyltransferase and a histone methyltransferase. In any of the embodiments herein, the at least one effector domain comprises a DNMT3A/L domain or a variant thereof. In any of the embodiments herein, the at least one effector domain comprises effector domain comprises the sequence set forth in SEQ ID NO: 604 and 607 a portion thereof, or an amino acid sequence that has at least 90%, 91%, 92%, 93%, 94%, 95%, 96%, 97%, 98%, or 99% sequence identity to any of the foregoing. In any of the embodiments herein, the at least one effector domain further comprises a KRAB domain or a variant thereof. In any of the embodiments herein, the at least one effector domain further comprises the sequence set forth in SEQ ID NO: 590 a portion thereof, or an amino acid sequence that has at least 90%, 91%, 92%, 93%, 94%, 95%, 96%, 97%, 98%, or 99% sequence identity to any of the foregoing. In any of the embodiments herein, the DNA-targeting system comprises a DNMT3A/3L-dSpCas9-KRAB domain or a variant thereof. In any of the embodiments herein, the DNA-targeting system comprises the sequence set forth in SEQ ID NO: 645 a portion thereof, or an amino acid sequence that has at least 90%, 91%, 92%, 93%, 94%, 95%, 96%, 97%, 98%, or 99% sequence identity to any of the foregoing.

In any of the embodiments herein, the DNA-targeting system comprises the sequence set forth in SEQ ID NO: 680 a portion thereof, or nucleic acid sequence that has at least 90%, 91%, 92%, 93%, 94%, 95%, 96%, 97%, 98%, or 99% sequence identity to the foregoing. In any of the embodiments herein, the DNA-targeting system comprises the sequence set forth in SEQ ID NO: 680.

Also provided herein is a method of repressing the transcription of one or more genes in Hepatitis B virus infected cell, the method comprising introducing into a Hepatitis B virus infected cell an epigenetic-modifying DNA-targeting system disclosed herein, the gRNA disclosed herein, the CRISPR Cas-gRNA combination disclosed herein, the polynucleotide disclosed herein, the plurality of polynucleotides disclosed herein, the vector disclosed herein, or a portion or a component of any of the foregoing. In some embodiments, the one or more genes are epigenetically modified by the DNA-targeting system. In some embodiments, the transcription of the one or more genes is reduced in comparison to a comparable cell not subjected to the method.

In any of the embodiments herein, the transcription of the one or more genes is reduced by at least about 1.25-fold, 1.5-fold, 1.75-fold, 2.0-fold, 2.5-fold, 2.75-fold, 3.0-fold, 3.5-fold, 3.75-fold, 4.0-fold, 4.5-fold, 4.75-fold, 5.0-fold, 5.25-fold, 5.5-fold, 5.75-fold, 6-fold. In any of the embodiments herein, repressing transcription of the one or more genes results in reduced HBV replication and/or HBV transcription. In any of the embodiments herein, the HBV infected cell is a mammalian cell.

In any of the embodiments herein, the HBV infected cell is a human cell. In any of the embodiments herein, the cell comprises integrated HBV DNA. In any of the embodiments herein, the cell is a hepatocyte comprising a pool of episomal HBV cccDNA. In any of the embodiments herein, the hepatocyte expresses HBV proteins, wherein the HBV proteins are HBsAg, and/or HBeAg. In any of the embodiments herein, the HBV infected cells in present in a subject.

In any of the embodiments herein, the subject is a human. In any of the embodiments herein, the subject has an HBV viral infection. In any of the embodiments herein, the subject has hepatocytes comprising integrated HBV DNA. In any of the embodiments herein, the subject has hepatocytes comprising a pool of episomal HBV cccDNA. In any of the embodiments herein, the subject has hepatocytes expressing HBV proteins, wherein the HBV proteins are HBsAg, HBeAg, or HBcrAg and combinations thereof.

In any of the embodiments herein, the subject has a disease, condition or disorder associated with the HBV viral infection. In any of the embodiments herein, the disease, condition, or disorder is a liver disease or a cancer. In any of the embodiments herein, the disease, condition, or disorder is acute hepatitis, chronic hepatitis, liver failure, or liver cirrhosis. In any of the embodiments herein, the disease, condition, or disorder is cancer, optionally wherein the cancer is hepatocellular cancer.

Also provided herein is a pharmaceutical composition comprising the vector disclosed herein. In any of the embodiments herein, the vector is conjugated to an amino sugar derivative of galactose, optionally wherein the vector is conjugated to an N-Acetylegalactosamine (GalNAc) moiety.

Also provided herein is a pharmaceutical composition comprising the epigenetic-modifying DNA-targeting system disclosed herein or the fusion protein disclosed herein, the gRNA disclosed herein, the CRISPR Cas-gRNA combination disclosed herein, the polynucleotide disclosed herein, the plurality of polynucleotides disclosed herein, the vector disclosed herein, or a portion or a component of any of the foregoing.

Also provided herein is a pharmaceutical composition for use in treating an HBV viral infection in a subject. In any of the embodiments herein, the subject has a disease, condition or disorder associated with the HBV viral infection.

Also provided herein is a pharmaceutical composition for use in treating a disease, disorder or condition in a subject associated with an HBV viral infection.

Also provided herein is a pharmaceutical composition for use in the manufacture of a medicament for treating an HBV viral infection in a subject. In some embodiments, the HBV viral infection is associated with a disease, disorder or condition.

Also provided herein is a pharmaceutical composition for use in the manufacture of a medicament for treating a disease, condition, or disorder in a subject associated with an HBV viral infection.

In any of the embodiments herein, the disease, condition, or disorder is liver disease or a cancer. In any of the embodiments herein, the disease, condition, or disorder is acute hepatitis, chronic hepatitis, liver failure, or liver cirrhosis. In any of the embodiments herein, the disease, condition, or disorder is cancer, optionally hepatocellular cancer. In any of the embodiments herein, the pharmaceutical composition is to be administered to the subject in vivo.

In any of the embodiments herein, following administration of the pharmaceutical composition, transcription of one or more HBV genes is repressed in cells of the subject. In any of the embodiments herein, the one or more HBV genes are involved in controlling HBV replication and/or HBV transcription. In any of the embodiments herein, the one or more genes is a polymerase gene, S-family gene, X-gene, or core family gene.

Also provided herein is a method for treating a disease, condition, or disorder in a subject in need thereof, comprising administering to the subject the epigenetic-modifying DNA-targeting system disclosed herein, the gRNA disclosed herein, the CRISPR Cas-gRNA combination disclosed herein, the polynucleotide disclosed herein, the plurality of polynucleotides disclosed herein, the vector disclosed herein, the pharmaceutical composition disclosed herein, or a portion or a component of any of the foregoing.

Also provided herein is a method of reducing Hepatitis B virus infection in a subject comprising administering to a subject that has a Hepatitis B virus infection, the epigenetic-modifying DNA-targeting system disclosed herein, the gRNA disclosed herein, the CRISPR Cas-gRNA combination disclosed herein, the polynucleotide disclosed herein, the plurality of polynucleotides disclosed herein, the vector disclosed herein, the pharmaceutical composition disclosed herein, or a portion or a component of any of the foregoing.

Also provided herein is an engineered zinc finger protein (eZFP) that binds to a target site in one or more HBV genes or regulatory elements thereof, wherein the target site is within a target region spanning 1033 bp-1749 bp of the HBV genome corresponding to positions with reference to the HBV genome set forth in SEQ ID NO: 650. In any of the embodiments herein, the target site is within a target region spanning within 300 base pairs upstream of the hepatitis B X protein (HBx) start codon. In any of the embodiments herein, the target site is positioned in the HBx basal core promoter region. In any of the embodiments herein, the target site is positioned within the HBx promoter/Enhancer region. In any of the embodiments herein, the target site is within a target region spanning within 250 base pairs upstream of the hepatitis B X protein (HBx) start codon. In any of the embodiments herein, the target site is within a target region spanning 1060-1480 bp of the HBV genome corresponding to positions with reference to the HBV genome set forth in SEQ ID NO: 650. In any of the embodiments herein, the target site is within a target region spanning within 150 base pairs upstream of the hepatitis B X protein (HBx) start codon. In any of the embodiments herein, the target site is within a target region spanning within 120 base pairs upstream of the hepatitis B X protein (HBx) start codon. In any of the embodiments herein, the target site is within a target region sequence corresponding to the sequence spanning 1250-1374 bp of the HBV genome with reference to the HBV genome set forth in SEQ ID NO: 650. In some embodiments, the target region has the sequence set forth in SEQ ID NO: 1068. In any of the embodiments herein, the target site is within a target region sequence corresponding to the sequence spanning 1255-1302 bp of the HBV genome with reference to the HBV genome set forth in SEQ ID NO: 650. In some embodiments, the target region has the sequence set forth in SEQ ID NO: 1069. In any of the embodiments herein, the target site, is within a target region sequence corresponding to the sequence spanning 1260-1300 bp of the HBV genome with reference to the HBV genome set forth in SEQ ID NO: 650. In some embodiments, the target region has the sequence set forth in SEQ ID NO: 1070. In any of the embodiments herein, the target site is within a target region sequence corresponding to the sequence spanning 1255 bp-1290 bp of the HBV genome with reference to the HBV genome set forth in SEQ ID NO: 650. In any of the embodiments herein, the target site comprises the nucleotide sequence set forth in any one of SEQ ID NOS: 1028-1055, a contiguous portion thereof of at least 12 nt, or a complementary sequence of any of the foregoing. In any of the embodiments herein, the target site comprises the nucleotide sequence set forth in any one of SEQ ID NOS: 1028-1055.

In any of the embodiments herein, the target site comprises the nucleotide sequence set forth in any one of SEQ ID NOS: 1045, 1046, or 1052, a contiguous portion thereof of at least 12 nt, or a complementary sequence of any of the foregoing. In any of the embodiments herein, the target site comprises the nucleotide sequence set forth in any one of SEQ ID NOS: 1045, 1046, or 1052.

In any of the embodiments herein, the zinc finger protein comprises six zinc fingers denoted F1 through F6 in order from N-terminus to C-terminus, and wherein the amino acid sequence of each zinc finger recognition region is as follows: 1) F1:SEADRSR(SEQ ID NO:720) F2:DRSNLTR (SEQ ID NO:721) F3:QSSDLSR(SEQ ID NO:722) F4:YHWYLKK(SEQ ID NO:723) F5:RSDSLSV(SEQ ID NO:724) F6:QNANRKT(SEQ ID NO:725); 2) F1:RSDVLST(SEQ ID NO:726) F2:DNSSRTR(SEQ ID NO:727) F3:RPYTLRL(SEQ ID NO:728) F4:DSSHRTR (SEQ ID NO:729) F5:RSDHLSQ(SEQ ID NO:730) F6:DSSHRTR(SEQ ID NO:731); 3) F1:RSDHLSQ(SEQ ID NO:732) F2:QSADRTK(SEQ ID NO:733) F3:RSDHLSQ (SEQ ID NO:734) F4:RRSDLKR(SEQ ID NO:735) F5:RSDHLSR(SEQ ID NO:736) F6:QSSDLRR(SEQ ID NO:737); 4) F1:RSDNLSE(SEQ ID NO:738) F2:TSSNRKT(SEQ ID NO:739) F3:DRSHLTR(SEQ ID NO:740) F4:RSDALTQ(SEQ ID NO:741) F5:DRSALAR (SEQ ID NO:742) F6:RRFTLSK(SEQ ID NO:743); 5) F1:RSDHLSE(SEQ ID NO:744) F2:QYSGRYY(SEQ ID NO:745) F3:HGQTLNE(SEQ ID NO:746) F4:QSGNLAR (SEQ ID NO:747) F5:RSDSLLR(SEQ ID NO:748)F6: CREYRGK(SEQ ID NO:749); 6) F1:QSANRTT(SEQ ID NO:750) F2:RSANLTR(SEQ ID NO:751) F3:RSDVLSE (SEQ ID NO:752) F4:TSGHLSR(SEQ ID NO:753) F5:QSSDLSR(SEQ ID NO:754), F6:QWSTRKR(SEQ ID NO:755); 7) F1:QSGNLAR(SEQ ID NO:756) F2:ATCCLAH(SEQ ID NO:757) F3:RWQYLPT(SEQ ID NO:758) F4:DRSALAR(SEQ ID NO:759) F5:RSDNLSE(SEQ ID NO:760)F6:KRCNLRC(SEQ ID NO:761); 8) F1:NPANLTR(SEQ ID NO:762) F2:QNATRTK(SEQ ID NO:763) F3:QSGHLAR(SEQ ID NO:764) F4:NRHDRAK (SEQ ID NO:765) F5:RSDHLSE(SEQ ID NO:766), F6:QRRSRYK(SEQ ID NO:767); 9) F1:QSSDLSR(SEQ ID NO:768) F2:HRSTRNR(SEQ ID NO:769) F3:RSDVLSA (SEQ ID NO:770) F4:DSRTRKN(SEQ ID NO:771) F5:QSGSLTR(SEQ ID NO:772) F6:DQSGLAH(SEQ ID NO:773); 10) F1:QNPAQWR(SEQ ID NO:774) F2:RSADLSR(SEQ ID NO:775) F3:TSGSLSR(SEQ ID NO:776) F4:RSDHLSR(SEQ ID NO:777) F5:RSDSLLR (SEQ ID NO:778) F6:QSYDRFQ(SEQ ID NO:779); 11) F1:TSGSLSR(SEQ ID NO:780) F2:RSDHLSR(SEQ ID NO:781) F3:RSDSLLR(SEQ ID NO:782) F4:QSYDRFQ (SEQ ID NO:783) F5:RSDNLST(SEQ ID NO:784) F6:DNRDRIK(SEQ ID NO:785); 12) F1:DRSNLSR(SEQ ID NO:786) F2:LRQNLIM(SEQ ID NO:787) F3:ERGTLAR(SEQ ID NO:788) F4:RSDALTQ(SEQ ID NO:789) F5:RSDSLSQ(SEQ ID NO:790) F6:RKADRTR(SEQ ID NO:791); 13) F1:QYCCLTN(SEQ ID NO:792) F2:TSGNLTR(SEQ ID NO:793) F3:QSSDLSR(SEQ ID NO:794) F4:FRYYLKR(SEQ ID NO:795) F5:QSGDLTR (SEQ ID NO:796) F6:DKGNLTK(SEQ ID NO:797); 14) F1:TSGSLSR(SEQ ID NO:798) F2:RSDNLTT(SEQ ID NO:799) F3:QSGNLAR(SEQ ID NO:800) F4:DRTTLMR (SEQ ID NO:801) F5:QSGHLAR(SEQ ID NO:802) F6:QLTHLNS(SEQ ID NO:803); 15) F1:IKHDLHR(SEQ ID NO:804) F2:RSANLTR(SEQ ID NO:805) F3:RSDNLAR(SEQ ID NO:806) F4:QNVSRPR(SEQ ID NO:807) F5:RSDDLSK(SEQ ID NO:808) F6:DSSHRTR(SEQ ID NO:809); 16) F1:RSDNLAR(SEQ ID NO:810) F2:QNVSRPR(SEQ ID NO:811) F3:RSDDLSK(SEQ ID NO:812) F4:DSSHRTR(SEQ ID NO:813) F5:TSSNRKT (SEQ ID NO:814) F6:AQWTRAC(SEQ ID NO:815); 17) F1:RSDDLSK(SEQ ID NO:816) F2:DSSHRTR(SEQ ID NO:817) F3:TSSNRKT(SEQ ID NO:818) F4:AQWTRAC (SEQ ID NO:819) F5:RKQTRTT(SEQ ID NO:820) F6:HRSSLRR(SEQ ID NO:821); 18) F1:QSAHRKN(SEQ ID NO:822) F2:TSSNRKT(SEQ ID NO:823) F3:RSDNLSA(SEQ ID NO:824) F4:RNNDRKT(SEQ ID NO:825) F5:TSGSLSR(SEQ ID NO:826) F6:QAGHLAK (SEQ ID NO:827); 19) F1:RSDHLSQ(SEQ ID NO:828) F2:ASSTRTK(SEQ ID NO:829) F3:RSDDLTR(SEQ ID NO:830) F4:QKSNLSS(SEQ ID NO:831) F5:QSANRTT (SEQ ID NO:832) F6:QNATRTK(SEQ ID NO:833); 20) F1:RSDTLSE(SEQ ID NO:834) F2:RRWTLVG(SEQ ID NO:835) F3:DRSNLSR(SEQ ID NO:836) F4:QSGDLTR (SEQ ID NO:837) F5:QSSDLSR(SEQ ID NO:838) F6:YHWYLKK(SEQ ID NO:839); 21) F1:RSANLAR(SEQ ID NO:840) F2:RSDNLRE(SEQ ID NO:841) F3:RPYTLRL(SEQ ID NO:842) F4:HRSNLNK(SEQ ID NO:843) F5:QSGSLTR(SEQ ID NO:844) F6:TSANLSR(SEQ ID NO:845); 22) F1:RSDDLVR(SEQ ID NO:846) F2:TSGSLVR(SEQ ID NO:847) F3:RSDKLVR(SEQ ID NO:848) F4:RSDELVR(SEQ ID NO:849) F5:TSHSLTE (SEQ ID NO:850) F6:RADNLTE(SEQ ID NO:851); 23) F1:ERSHLRE(SEQ ID NO:852) F2:TSHSLTE(SEQ ID NO:853) F3:QAGHLAS(SEQ ID NO:854) F4:TSHSLTE (SEQ ID NO:855) F5:DPGHLVR(SEQ ID NO:856) F6:TSGNLVR(SEQ ID NO:857); 24) F1:RADNLTE(SEQ ID NO:858) F2:TSGSLVR(SEQ ID NO:859) F3:RKDNLKN(SEQ ID NO:860) F4:QSSSLVR(SEQ ID NO:861) F5:RSDKLVR(SEQ ID NO:862) F6:DSGNLRV (SEQ ID NO:863); 25) F1:QSSSLVR(SEQ ID NO:864) F2:QSGDLRR(SEQ ID NO:865) F3:RSDERKR(SEQ ID NO:866) F4:HRTTLTN(SEQ ID NO:867) F5:RSDHLTN (SEQ ID NO:868) F6:TSGELVR(SEQ ID NO:869); 26) F1:QSGDLRR(SEQ ID NO:870) F2:RSDERKR(SEQ ID NO:871) F3:HRTTLTN(SEQ ID NO:872) F4:RSDHLTN (SEQ ID NO:873) F5:TSGELVR(SEQ ID NO:874) F6:RSDDLVR(SEQ ID NO:875); 27) F1:QRAHLER(SEQ ID NO:876) F2:QLAHLRA(SEQ ID NO:877) F3:DPGHLVR(SEQ ID NO:878) F4:RRSACRR(SEQ ID NO:879) F5:RSDHLTT(SEQ ID NO:880) F6:QSSSLVR (SEQ ID NO:881); and 28) F1:QSSNLVR(SEQ ID NO:882) F2:RSDDLVR(SEQ ID NO:883) F3:THLDLIR(SEQ ID NO:884) F4:TSGNLTE(SEQ ID NO:885) F5:RRSACRR (SEQ ID NO:886) F6:RNDTLTE(SEQ ID NO:887).

In any of the embodiments herein, the zinc finger protein comprises six zinc fingers denoted F1 through F6 in order from N-terminus to C-terminus, and wherein the amino acid sequence of each zinc finger recognition region is as follows: F1:QSAHRKN(SEQ ID NO:822) F2:TSSNRKT(SEQ ID NO:823) F3:RSDNLSA(SEQ ID NO:824) F4:RNNDRKT(SEQ ID NO:825) F5:TSGSLSR(SEQ ID NO:826) F6:QAGHLAK(SEQ ID NO:827).

In any of the embodiments herein, the zinc finger protein comprises six zinc fingers denoted F1 through F6 in order from N-terminus to C-terminus, and wherein the amino acid sequence of each zinc finger recognition region is as follows: F1:RSDHLSQ(SEQ ID NO:828) F2:ASSTRTK(SEQ ID NO:829) F3:RSDDLTR(SEQ ID NO:830) F4:QKSNLSS(SEQ ID NO:831) F5:QSANRTT(SEQ ID NO:832) F6:QNATRTK(SEQ ID NO:833).

In any of the embodiments herein, the zinc finger protein comprises six zinc fingers denoted F1 through F6 in order from N-terminus to C-terminus, and wherein the amino acid sequence of each zinc finger recognition region is as follows: F1:QSSSLVR(SEQ ID NO:864) F2:QSGDLRR(SEQ ID NO:865) F3:RSDERKR(SEQ ID NO:866) F4:HRTTLTN(SEQ ID NO:867) F5:RSDHLTN(SEQ ID NO:868) F6:TSGELVR(SEQ ID NO:869).

Also provided herein is an eZFP that binds to a target site in one or more HBV genes or regulatory elements thereof, wherein the zinc finger protein comprises six zinc fingers denoted F1 through F6 in order from N-terminus to C-terminus, and wherein the amino acid sequence of each zinc finger recognition region is as follows: 1) F1:SEADRSR (SEQ ID NO:720) F2:DRSNLTR(SEQ ID NO:721) F3:QSSDLSR(SEQ ID NO:722) F4:YHWYLKK(SEQ ID NO:723) F5:RSDSLSV(SEQ ID NO:724) F6:QNANRKT (SEQ ID NO:725); 2) F1:RSDVLST(SEQ ID NO:726) F2:DNSSRTR(SEQ ID NO:727) F3:RPYTLRL(SEQ ID NO:728) F4:DSSHRTR(SEQ ID NO:729) F5:RSDHLSQ (SEQ ID NO:730) F6:DSSHRTR(SEQ ID NO:731); 3) F1:RSDHLSQ(SEQ ID NO:732) F2:QSADRTK(SEQ ID NO:733) F3:RSDHLSQ(SEQ ID NO:734) F4:RRSDLKR (SEQ ID NO:735) F5:RSDHLSR(SEQ ID NO:736) F6:QSSDLRR(SEQ ID NO:737); 4) F1:RSDNLSE(SEQ ID NO:738) F2:TSSNRKT(SEQ ID NO:739) F3:DRSHLTR (SEQ ID NO:740) F4:RSDALTQ(SEQ ID NO:741) F5:DRSALAR(SEQ ID NO:742) F6:RRFTLSK(SEQ ID NO:743); 5) F1:RSDHLSE(SEQ ID NO:744) F2:QYSGRYY(SEQ ID NO:745) F3:HGQTLNE(SEQ ID NO:746) F4:QSGNLAR (SEQ ID NO:747) F5:RSDSLLR(SEQ ID NO:748) F6:CREYRGK(SEQ ID NO:749); 6) F1:QSANRTT(SEQ ID NO:750) F2:RSANLTR(SEQ ID NO:751) F3:RSDVLSE(SEQ ID NO:752) F4:TSGHLSR(SEQ ID NO:753) F5:QSSDLSR(SEQ ID NO:754), F6:QWSTRKR (SEQ ID NO:755); 7) F1:QSGNLAR(SEQ ID NO:756) F2:ATCCLAH(SEQ ID NO:757) F3:RWQYLPT(SEQ ID NO:758) F4:DRSALAR(SEQ ID NO:759) F5:RSDNLSE (SEQ ID NO:760)F6:KRCNLRC(SEQ ID NO:761); 8) F1:NPANLTR(SEQ ID NO:762) F2:QNATRTK(SEQ ID NO:763) F3:QSGHLAR(SEQ ID NO:764) F4:NRHDRAK (SEQ ID NO:765) F5:RSDHLSE(SEQ ID NO:766), F6:QRRSRYK(SEQ ID NO:767); 9) F1:QSSDLSR(SEQ ID NO:768) F2:HRSTRNR(SEQ ID NO:769) F3:RSDVLSA (SEQ ID NO:770) F4:DSRTRKN(SEQ ID NO:771) F5:QSGSLTR(SEQ ID NO:772) F6:DQSGLAH(SEQ ID NO:773); 10) F1:QNPAQWR(SEQ ID NO:774) F2:RSADLSR(SEQ ID NO:775) F3:TSGSLSR(SEQ ID NO:776) F4:RSDHLSR(SEQ ID NO:777) F5:RSDSLLR (SEQ ID NO:778) F6:QSYDRFQ(SEQ ID NO:779); 11) F1:TSGSLSR(SEQ ID NO:780) F2:RSDHLSR(SEQ ID NO:781) F3:RSDSLLR(SEQ ID NO:782) F4:QSYDRFQ (SEQ ID NO:783) F5:RSDNLST(SEQ ID NO:784) F6:DNRDRIK(SEQ ID NO:785); 12) F1:DRSNLSR(SEQ ID NO:786) F2:LRQNLIM(SEQ ID NO:787) F3:ERGTLAR(SEQ ID NO:788) F4:RSDALTQ(SEQ ID NO:789) F5:RSDSLSQ(SEQ ID NO:790) F6:RKADRTR(SEQ ID NO:791); 13) F1:QYCCLTN(SEQ ID NO:792) F2:TSGNLTR(SEQ ID NO:793) F3:QSSDLSR(SEQ ID NO:794) F4:FRYYLKR(SEQ ID NO:795) F5:QSGDLTR (SEQ ID NO:796) F6:DKGNLTK(SEQ ID NO:797); 14) F1:TSGSLSR(SEQ ID NO:798) F2:RSDNLTT(SEQ ID NO:799) F3:QSGNLAR(SEQ ID NO:800) F4:DRTTLMR (SEQ ID NO:801) F5:QSGHLAR(SEQ ID NO:802) F6:QLTHLNS(SEQ ID NO:803); 15) F1:IKHDLHR(SEQ ID NO:804) F2:RSANLTR(SEQ ID NO:805) F3:RSDNLAR(SEQ ID NO:806) F4:QNVSRPR(SEQ ID NO:807) F5:RSDDLSK(SEQ ID NO:808) F6:DSSHRTR(SEQ ID NO:809); 16) F1:RSDNLAR(SEQ ID NO:810) F2:QNVSRPR(SEQ ID NO:811) F3:RSDDLSK(SEQ ID NO:812) F4:DSSHRTR(SEQ ID NO:813) F5:TSSNRKT (SEQ ID NO:814) F6:AQWTRAC(SEQ ID NO:815); 17) F1:RSDDLSK(SEQ ID NO:816) F2:DSSHRTR(SEQ ID NO:817) F3:TSSNRKT(SEQ ID NO:818) F4:AQWTRAC (SEQ ID NO:819) F5:RKQTRTT(SEQ ID NO:820) F6:HRSSLRR(SEQ ID NO:821); 18) F1:QSAHRKN(SEQ ID NO:822) F2:TSSNRKT(SEQ ID NO:823) F3:RSDNLSA(SEQ ID NO:824) F4:RNNDRKT(SEQ ID NO:825) F5:TSGSLSR(SEQ ID NO:826) F6:QAGHLAK (SEQ ID NO:827); 19) F1:RSDHLSQ(SEQ ID NO:828) F2:ASSTRTK(SEQ ID NO:829) F3:RSDDLTR(SEQ ID NO:830) F4:QKSNLSS(SEQ ID NO:831) F5:QSANRTT (SEQ ID NO:832) F6:QNATRTK(SEQ ID NO:833); 20) F1:RSDTLSE(SEQ ID NO:834) F2:RRWTLVG(SEQ ID NO:835) F3:DRSNLSR(SEQ ID NO:836) F4:QSGDLTR (SEQ ID NO:837) F5:QSSDLSR(SEQ ID NO:838) F6:YHWYLKK(SEQ ID NO:839); 21) F1:RSANLAR(SEQ ID NO:840) F2:RSDNLRE(SEQ ID NO:841) F3:RPYTLRL(SEQ ID NO:842) F4:HRSNLNK(SEQ ID NO:843) F5:QSGSLTR(SEQ ID NO:844) F6:TSANLSR(SEQ ID NO:845); 22) F1:RSDDLVR(SEQ ID NO:846) F2:TSGSLVR(SEQ ID NO:847) F3:RSDKLVR(SEQ ID NO:848) F4:RSDELVR(SEQ ID NO:849) F5:TSHSLTE (SEQ ID NO:850) F6:RADNLTE(SEQ ID NO:851); 23) F1:ERSHLRE(SEQ ID NO:852) F2:TSHSLTE(SEQ ID NO:853) F3:QAGHLAS(SEQ ID NO:854) F4:TSHSLTE (SEQ ID NO:855) F5:DPGHLVR(SEQ ID NO:856) F6:TSGNLVR(SEQ ID NO:857); 24) F1:RADNLTE(SEQ ID NO:858) F2:TSGSLVR(SEQ ID NO:859) F3:RKDNLKN(SEQ ID NO:860) F4:QSSSLVR(SEQ ID NO:861) F5:RSDKLVR(SEQ ID NO:862) F6:DSGNLRV (SEQ ID NO:863); 25) F1:QSSSLVR(SEQ ID NO:864) F2:QSGDLRR(SEQ ID NO:865) F3:RSDERKR(SEQ ID NO:866) F4:HRTTLTN(SEQ ID NO:867) F5:RSDHLTN (SEQ ID NO:868) F6:TSGELVR(SEQ ID NO:869); 26) F1:QSGDLRR(SEQ ID NO:870) F2:RSDERKR(SEQ ID NO:871) F3:HRTTLTN(SEQ ID NO:872) F4:RSDHLTN (SEQ ID NO:873) F5:TSGELVR(SEQ ID NO:874) F6:RSDDLVR(SEQ ID NO:875); 27) F1:QRAHLER(SEQ ID NO:876) F2:QLAHLRA(SEQ ID NO:877) F3:DPGHLVR(SEQ ID NO:878) F4:RRSACRR(SEQ ID NO:879) F5:RSDHLTT(SEQ ID NO:880) F6:QSSSLVR (SEQ ID NO:881); and 28) F1:QSSNLVR(SEQ ID NO:882) F2:RSDDLVR(SEQ ID NO:883) F3:THLDLIR(SEQ ID NO:884) F4:TSGNLTE(SEQ ID NO:885) F5:RRSACRR (SEQ ID NO:886) F6:RNDTLTE(SEQ ID NO:887).

In any of the embodiments herein, the engineered zinc finger protein comprises the sequence set forth in any one of SEQ ID NOS: 692-719, or a portion thereof, or an amino acid sequence that has at least 90%, 91%, 92%, 93%, 94%, 95%, 96%, 97%, 98%, or 99% sequence identity thereto. In any of the embodiments herein, the engineered zinc finger protein is encoded by the sequence set forth in any one of SEQ ID NOS:888-915, or a portion thereof, or nucleotide sequence that has at least 90%, 91%, 92%, 93%, 94%, 95%, 96%, 97%, 98%, or 99% sequence identity thereto.

Also provided herein is an engineered zinc finger protein that binds to a target site in one or more HBV genes or regulatory elements thereof, wherein the zinc finger protein comprises six zinc fingers denoted F1 through F6 in order from N-terminus to C-terminus, F1:QSAHRKN(SEQ ID NO:822) F2:TSSNRKT(SEQ ID NO:823) F3:RSDNLSA (SEQ ID NO:824) F4:RNNDRKT(SEQ ID NO:825) F5:TSGSLSR(SEQ ID NO:826) F6:QAGHLAK(SEQ ID NO:827). In some embodiments, the engineered zinc finger protein comprises the sequence set forth in SEQ ID NO: 709, or a portion thereof, or an amino acid sequence that has at least 90%, 91%, 92%, 93%, 94%, 95%, 96%, 97%, 98%, or 99% sequence identity thereto. In some embodiments, the engineered zinc finger protein comprises the sequence set forth in any one of SEQ ID NOS: 709. In some embodiments, the engineered zinc finger protein is encoded by the sequence set forth in SEQ ID NO:905, or a portion thereof, or nucleotide sequence that has at least 90%, 91%, 92%, 93%, 94%, 95%, 96%, 97%, 98%, or 99% sequence identity thereto. In some embodiments, the engineered zinc finger protein is encoded by the sequence set forth in any one of SEQ ID NOS:905.

Also provided herein is an engineered zinc finger protein that binds to a target site in one or more HBV genes or regulatory elements thereof, wherein the zinc finger protein comprises six zinc fingers denoted F1 through F6 in order from N-terminus to C-terminus, and wherein the amino acid sequence of each zinc finger recognition region is as follows: F1:RSDHLSQ(SEQ ID NO:828) F2:ASSTRTK(SEQ ID NO:829) F3:RSDDLTR(SEQ ID NO:830) F4:QKSNLSS(SEQ ID NO:831) F5:QSANRTT(SEQ ID NO:832) F6:QNATRTK(SEQ ID NO:833). In some embodiments, the engineered zinc finger protein comprises the sequence set forth in SEQ ID NO: 710, or a portion thereof, or an amino acid sequence that has at least 90%, 91%, 92%, 93%, 94%, 95%, 96%, 97%, 98%, or 99% sequence identity thereto. In some embodiments, the engineered zinc finger protein comprises the sequence set forth in any one of SEQ ID NOS: 710. In some embodiments, the engineered zinc finger protein is encoded by the sequence set forth in SEQ ID NO:906, or a portion thereof, or nucleotide sequence that has at least 90%, 91%, 92%, 93%, 94%, 95%, 96%, 97%, 98%, or 99% sequence identity thereto. In some embodiments, the engineered zinc finger protein is encoded by the sequence set forth in any one of SEQ ID NOS: 906.

Also provided herein is an engineered zinc finger protein that binds to a target site in one or more HBV genes or regulatory elements thereof, wherein the zinc finger protein comprises six zinc fingers denoted F1 through F6 in order from N-terminus to C-terminus, and wherein the amino acid sequence of each zinc finger recognition region is as follows: F1:QSSSLVR(SEQ ID NO:864) F2:QSGDLRR(SEQ ID NO:865) F3:RSDERKR(SEQ ID NO:866) F4:HRTTLTN(SEQ ID NO:867) F5:RSDHLTN(SEQ ID NO:868) F6:TSGELVR(SEQ ID NO:869). In some embodiments, the engineered zinc finger protein comprises the sequence set forth in SEQ ID NO: 716, or a portion thereof, or an amino acid sequence that has at least 90%, 91%, 92%, 93%, 94%, 95%, 96%, 97%, 98%, or 99% sequence identity thereto. In some embodiments, the engineered zinc finger protein comprises the sequence set forth in any one of SEQ ID NOS: 716. In some embodiments, the engineered zinc finger protein is encoded by the sequence set forth in SEQ ID NO:912, or a portion thereof, or nucleotide sequence that has at least 90%, 91%, 92%, 93%, 94%, 95%, 96%, 97%, 98%, or 99% sequence identity thereto. In some embodiments, the engineered zinc finger protein is encoded by the sequence set forth in any one of SEQ ID NOS:912.

BRIEF DESCRIPTION OF THE DRAWINGS

FIG. 11 lists single gRNAs that targeted HBV cccDNA and integrated DNA and achieved multiplexed HBV repression at multiple genes and regulatory elements thereof.

FIG. 12 lists sequences targeted by single gRNAs that achieved multiplexed HBV repression at multiple genes and regulatory elements thereof.

FIG. 15A shows repression mediated by HBVg_22 (SEQ ID NO: 412) of the HBV RNA from two PHH donors. FIG. 15B shows repression mediated by HBVg_22 (SEQ ID NO: 412) in PHH cells infected with two doses of HBV.

FIG. 26 depicts the fold change in the post-dose to pre-dose metric.

FIG. 28A shows stable repression following a single dose of LNP containing mRNA encoding DNMT3A/3L-dSpCas9-KRAB and HBVg_22 (SEQ ID NO: 412) on Day 33. FIG. 28B shows single mouse tracks of the degree of repression. FIG. 28C shows tissue samples with marked reductions in pgRNA signal in HBVg_22 (SEQ ID NO: 412)-delivered mice as compared to mice that received a non-targeting gRNA.

FIG. 31B depicts the sites in the HBx region (sequence between 1213 bp to 1322 bp (SEQ ID NOS: 1072-1073) of the HBV genome set forth in SEQ ID NO: 650) targeted by the gRNAs HBVg_22 and HBVg_63 and the ZFP-KRAB fusion proteins eZFP_18, eZFP_19, and eZFP_25.

FIG. 32A-FIG. 32B depict the fold change in total HBV RNA mediated by each eZFP-KRAB fusion protein in HepG2.NTCP cells.

DETAILED DESCRIPTION

Figure 1:
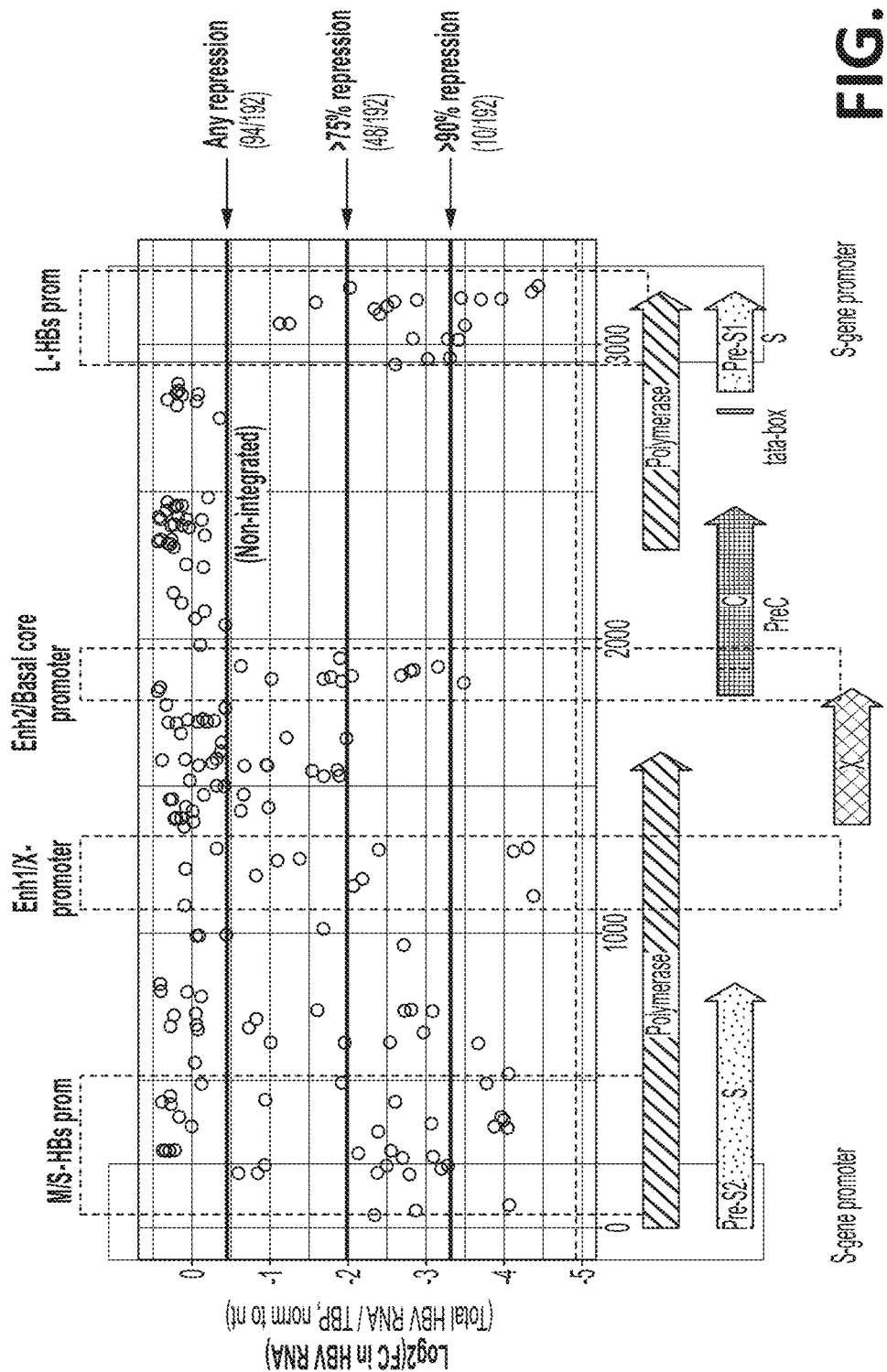
FIG. 1 depicts the fold change in total HBV RNA mediated by each guide RNA and a dCas9-KRAB effector fusion protein. The fold change is depicted in relation to the median targeting position of each gRNA across all HBV genotypes.
Figure 2:
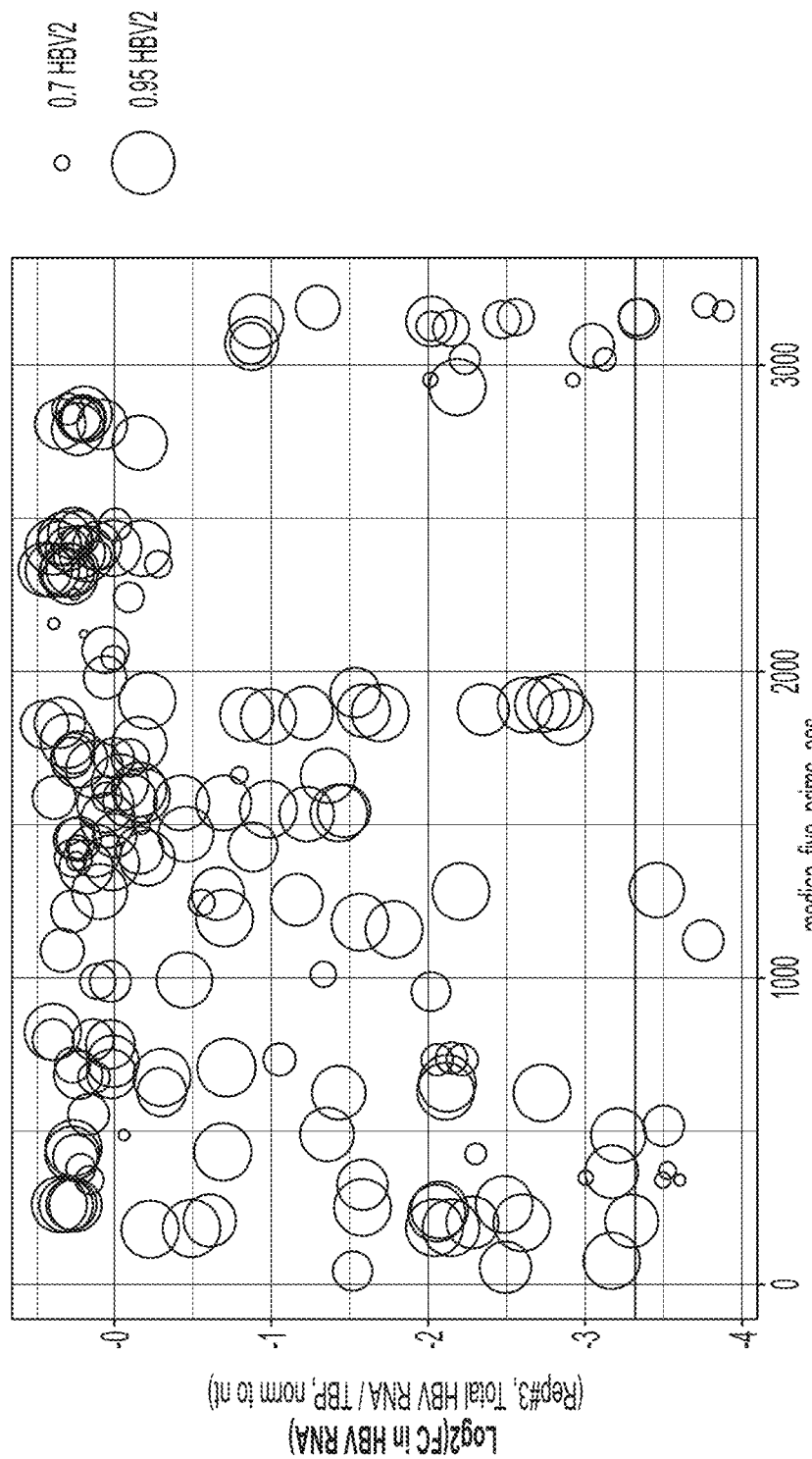
FIG. 2 depicts the conservation of the guide RNAs across the HBV genome types (HBV0-HBV12).

Hepatitis B is a potentially life-threatening liver infection caused by the Hepatitis B virus (HBV). HBV infection is a global public health problem causing chronic liver infection and increasing the risk for liver cirrhosis and liver cancer. The WHO estimated that 296 million people worldwide with 1 million people in the U.S., were living with chronic hepatitis B infections in 2019, with 1.5 million new infections each year. In 2019, hepatitis B resulted in an estimated 820,000 deaths, mostly from cirrhosis and hepatocellular carcinoma (primary liver cancer).

HBV belongs to the Hepadnaviridae family, a family of small enveloped hepatotropic DNA viruses (Wei L. and Ploss A. Nature communications 12(1591) 1-13 (2021)). The HBV virion contains a compact, partially double-stranded, about 3.2 kb relaxed circular DNA (rcDNA) genome. The genome contains four lesions: a covalently linked HBV polymerase and a 10 nucleotide (nt) DNA flap on the 5'-end of the minus strand; and a 5'-capped RNA primer and single-stranded DNA (ssDNA) gap on the plus-strand. The HBV genome is an about 3.2 kilobase double-stranded DNA molecule, but can be longer or shorter depending on the particular HBV strain (e.g. up to 3300 bp or more in size). An exemplary HBV genome is the Hepatitis B Virus genome (Hepatitis B virus subtype ayw, complete genome, GenBank: U95551.1), SEQ ID NO: 650. At least 10 genotypes (A to J) have been identified with a divergence of no more than 8% between genotypes. Subgenotypes also exist including subgenotypes classified as HBV genotype A (A1-A7), genotype B (B1-B9), genotype C (C1-16), genotype D (D1-D8), and genotype F (F1-F4) (Zhang et al. World J Gastroenterol, 2015, 22:126-144). Within sub-genotypes the sequence identity divergence is only about 4%. It is understood that the provided systems and methods are applicable to a plurality of HBV genomes, particularly given the high sequence similarity. For purposes herein, reference to numbering of nucleotide positions is nucleotide (base pair) numbering of HBV DNA sequence described under GenBank accession no. U95551.1, set forth in SEQ ID NO:650. A skilled artisan understands that target site or base pair positions, such as described herein, in another HBV genome may not be at the identical position but nevertheless may be a homologous sequence or substantially homologous sequence (e.g. 1, 2 or 3 mismatches), such as determined by alignment of an HBV genome sequence with the sequence set forth in SEQ ID NO:650. A corresponding position or positions may thus be readily identified by alignment of an HBV genome sequence with the reference sequence set forth in SEQ ID NO:650. The Hepatitis B virus contains a circular genome and therefore for the purposes herein references to numbering of nucleotide positions of a linear HBV DNA sequence may shift by a few nucleotides, such as depending on the start of a linear sequence. For instance, the sequence set forth in SEQ ID NO:650 and SEQ ID NO: 1071 are the same sequence but the start of the linear sequences shifts by two nucleotides due to differences in the start of the linerar sequence. It is well within the level of a skilled artisan to identify corresponding sequence regions between and among different sequences of an HBV genome sequence.

The HBV lifecycle includes processes, such as viral entry, cccDNA formation, transcription, replication, assembly, secretion, and integration. Following viral entry into hepatocytes via the bile acid transporter NTCP11, the viral nucleocapsid harboring the HBV rcDNA is transported to the nucleus. The rcDNA is released, and the four lesions on the rcDNA are fully repaired to form a supercoiled cccDNA molecule (also called minichromosomes). The viral repair factors are dispensable for repair and the cccDNA often relies on host DNA repair machinery, including TDP2, DNA polymerase (POL) K, POLa, DNA ligase 1 and 3, and flap endonuclease 1. The HBV hijacks host ubiquitous and liver-enriched transcription factors for cccDNA transcriptional regulation. The cccDNA is the key viral depot driving chronic HBV infection and serves as the template for all HBV viral transcripts. Another form of HBV DNA in the host is the stably integrated HBV DNA in the host genome (Zhao K., et al., Cell Press—The Innovation 1(2): 1-10 (2020). Double-stranded linear DNA (dslDNA) is the dominant substrate for integration into the host genome. As there is almost no sequence homology between the viral DNA and the cellular DNA, NHEJ DNA repair pathway is proposed as a mechanism for HBV DNA integration. HBV DNA integration occurs throughout the host genome at double stranded breaks, with terminal deletions up to 200 bp from the integrated HBV DNA being common. No specific chromosomal hot-spots or common recurring sites have been observed between patients. There is some evidence for enrichment in particular genomic sites in tumour tissues (Sung W., et al., Nature Genetics 44(7):765-9 (2012)). Although no progeny virus is produced, integrated HBV DNA can produce viral RNAs and proteins. HBV DNA integration occurs more often in hepatic cancer cells (84%) than in normal liver tissues (30%).

Current standard of care includes nucleoside analogs (e.g., lamivudine) and PEGlyated interferon therapies. Nucleoside analogs act by inhibiting HBV polymerase activity resulting in a decrease in viral replication. However, prolonged treatment periods, increase in viral resistance and emergence of mutant strains, have reduced the effectiveness of nucleoside therapies (Papatheodoridis G.V. et al., Am. J. Gastroenterol 97(7):1618-28 (2002). PEGlyated interferon therapy either alone or in combination with nucleoside analogs (e.g., lamivudine) has been tested to suppress transcription of viral DNA. PEGylated interferon therapy has been shown to mediate divergent effects on the innate and adaptive arms of the immune system, with strinkingly depleting effects on CD8 T cells, limiting the efficacy of the therapy (Micco L., et al., Journal of Hepatology 58(2): 225-233 (2013); Stelma F., et al., Journal f Infectious Disease 212(7):1042-51 (2015) marcellin P., et al., New England Journal of Medicine 351(12):1206-17 (2004)). Nucleotide analogs nor PEGylated therapies are able to clear or suppress production of HBV surface antigen (HBsAg), which has been linked to poor prognosis of HBV infection. Other therapies including antisense oligonucleotide (ASO) and siRNA approaches centered at reducing HBsAg to reach functional cures (Billioud G., et al., Journal of Hepatology 64(4):781-9 (2015); Gane E., et al., Hepatology 74(4):1795-1808 (2021); Flisiak R., et al., Expert Opinion on Biology Therapy 18(6) 609-617) have shown to be promising in inhibiting HBsAg, HBeAg, and HBV DNA synthesis. However, the functional benefit of any of these therapies on the regeneration of liver tissue is unclear.

Current antiviral therapies rarely achieve a cure as they inhibit cytoplasmic HBV genome replication and do not directly target the cccDNA form-a form that serves as an HBV replication intermediate and viral persistence reservoir (Yang G., et al., Theranostics 9(24):7345-58 (2019)). Genome engineering approaches such as nucleases or base editors target removal or mutagenesis of the cccDNA pool in order to functionally cure the infection. However, such nuclease-based therapies have a chance of generating chromosomal abnormalities and therefore are not preferred, highlighting the need for better HBV therapeutics.

The persistence of the episomal cccDNA pool in infected hepatocytes remains a critical obstacle in complete elimination by anti-HBV therapies. The cccDNA accumulates in the nucleus as a chromatin-like cccDNA minichromosome assembled by histones and non-histones. The cccDNA shows unusual chromatin regulation due to its non-native status. For instance, changes the epigenetic states of the cccDNA have been found to dictate its transcriptional activity (Yang G., et al., Theranostics 9(24):7345-58 (2019). For example, the host nucleosome assembly machinery (HAT1/CAF-1) acetylates histone H4 at the sites of H4K5 and H4K12 contributing to the assembly of the cccDNA. The acetylation marks on the histones of the cccDNA in turn promote HBV replication and accumulation of the cccDNA. This transcriptional activity is largely driven by the presence of absence of activating epigenetic marks on the cccDNA; repressive histone marks (e.g., H3K27me3 and H3K9me3) are minute, suggesting that there is limited repression in the cccDNA (Tropberger P. et al., PNAS, 112(42):E5715-E5724 (2015), Riviere L., et al., J Hepatol 15(00450):S0168-8278 (2015)).

Desirable clinical outcomes have been associated with key epigenetic features within the cccDNA minichromosome. Studies have found that cccDNA contains methylation-prone CpG islands that are connected to the behavior of HBV (Zhang Y., et al., PlosOne 9(10):e110442 (2014), Vivekanandan P, et al., Journal of infectious diseases, 199 (9):1286-1291 (2009), Vivekanandan P, et al., Journal of Virology, 84(9):4321-4329 (2010), Vivekanandan P. et al., Journal of Viral hepatitis 15(2):103-107 (2008), Jain S., et al., Scientific Reports 5: 10478 (2015)). Methylation of CpG islands II and III has been correlated to low levels of serum HBV DNA and HBsAg titres in patients (Zhang Y., et al., PlosOne 9(10):e110442 (2014)). HBV genotype, HBeAg positivity, patient age, and liver fibrosis stage have been found to correlate to cccDNA CpG methylation status. In vitro methylation studies have further confirmed that CpG island II methylation can markedly reduce cccDNA transcription and subsequent viral core DNA replication (Zhang Y., et al., PlosOne 9(10):e110442 (2014)), establishing the importance of chromatin for cccDNA regulation and as a potential target for therapy of chronic HBV infections. Anti-virals and broad epigenetic-modifying agents, such as IFNα have been attributed to reducing active histone post translational modifications thereby transcriptionally down-regulating transcription of cccDNA (Tropberger P. et al., PNAS, 112(42):E5715-E5724 (2015), Belloni L, et al., Journal of Clinical investigation 122L529-537 (2012), Allweiss L., et al., Journal of Hepatology 60:500-507 (2014), Lucifora J., et al., Science 343: 1221-1228 (2014)).

The provided embodiments are based on a recognition that epigenetically silencing one or more HBV viral genes, including those present on the cccDNA, might be a viable therapeutic approach to curing HBV infections. Disclosed herein are approaches to achieve amelioration of infection, and in some cases potentially a functional cure, from HBV via precise epigenetic silencing of the cccDNA form, relaxed circular DNA (rcDNA) form and of the HBV integrated into the human genomic DNA. The approaches described herein demonstrate high efficacy, safety, and stability. In some embodiments, the approaches target all the forms of HBV in the same approach, utilize non-mutagenic platforms, and targeting the source of transcription rather than downstream transcripts. As methylation can be inherited by the cellular progeny, the durability of the epi-editing approaches offers promise for treatment of HBV infection. In some embodiments, the approaches described herein target multiple locations on the virus genome to ensure deep and durable response across HBV variants. In some embodiments, the epigenetic approaches result in silencing of HBV replication, HBV transcription, and production of proteins form the HBV DNA. The provided embodiments are not contingent on immune reboot nor on infected hepatocyte clearance but are based on a direct epigenetic silencing (e.g., HBV repression).

Among provided embodiments herein is an epigenetic-modifying DNA-targeting system comprising at least one DNA-targeting module for repressing transcription of one or more Hepatitis B viral (HBV) genes and/or regulatory elements thereof; wherein each of the at least one DNA-targeting module comprises a fusion protein comprising: (a) a DNA-binding domain for targeting to a target site in a Hepatitis B viral DNA sequence; and (b) at least one transcriptional repressor effector domain. In some embodiments, the provided epigenetic-modifying DNA-targeting systems are for multiplexed targeted repression of a plurality of different genes or regulatory elements thereof that regulate Hepatitis B viral (HBV) replication and/or HBV transcription. In some embodiments, the epigenetic-modifying DNA-targeting system comprises a plurality of DNA-targeting modules for repressing transcription of a plurality of genes or regulatory elements thereof that regulate Hepatitis B viral (HBV) replication and/or HBV transcription. In some embodiments, the DNA-targeting module comprises (a) a fusion protein comprising a Clustered Regularly Interspaced Short Palindromic Repeats associated (Cas) protein or variant thereof and at least one transcriptional repressor effector domain; and (b) a plurality of guide RNAs (gRNAs) comprising at least a first gRNA and a second gRNA. In some embodiments, the first gRNA targets a target site of a first gene or regulatory element thereof and the second gRNA targets a target site of a second gene or regulatory element thereof. The first and second genes or regulatory elements thereof regulate Hepatitis B virus replication and/or HBV transcription. Also provided herein are polynucleotides encoding the DNA-targeting systems or fusion proteins of the DNA-targeting systems, vectors, and compositions containing the same.

In some embodiments of the provided epigenetic-modifying DNA-targeting system, the DNA binding domain is a nuclease-inactive Clustered Regularly Interspaced Short Palindromic Repeats associated (Cas) protein or variant thereof, such as a dead Cas (dCas, e.g. dCas9), and the DNA-targeting system further includes at least one gRNA that can complex with the Cas. In some embodiments, the DNA-binding domain is a nuclease-inactive Clustered Regularly Interspaced Short Palindromic Repeats associated (Cas) protein or variant thereof complexed with a guide RNA (gRNA). In such systems, the gRNA has a spacer sequence that is capable of hybridizing to the target site of the gene or regulatory element thereof. Also provided herein are related gRNAs, including Cas/gRNA combinations, polynucleotides, compositions, and methods involving or related to the epigenetic-modifying DNA targeting systems.

In some embodiments of the provided epigenetic-modifying DNA-targeting system, the DNA-binding domain is a protein domain that is engineered for sequence-specific binding to the target site. For example, in some embodiments, the DNA-binding domain is a zinc-finger (ZFN)-based DNA-binding domain, or transcription activator-like effector DNA-binding domain, as described herein.

Also provided herein are methods of using the epigenetic-modifying DNA-targeting system for modulating transcription or a phenotype of liver cells. Also provided herein are methods of using the epigenetic-modifying DNA-targeting systems for repressing HBV replication and/or protein levels. In some embodiments, the methods can be used in therapies for treating HBV infections, such as hepatitis.

In some embodiments, the target site is present in a covalently closed circular DNA (cccDNA), relaxed circular DNA (rcDNA) and/or is integrated in the genomic DNA. In some embodiments, the target site is at or near a gene or regulatory element thereof involved in HBV replication and/or HBV transcription, such as a regulatory element or a coding region. Also provided herein are epigenetic-modifying DNA-targeting systems that are multiplexed with a plurality of DNA-targeting modules such that the system is able to target a combination of such genes or regulatory elements thereof. In some embodiments, each module of the DNA-targeting system represses transcription of a different gene. Also provided herein are methods of using the epigenetic-modifying DNA-targeting systems for reducing the HBV replication and/or transcription. In some embodiments, the methods can be used in treating liver disease (e.g., hepatitis), cancer (e.g., hepatocellular carcinoma), or HBV infection (acute or chronic hepatitis).

Hence, in some embodiments, the DNA-targeting systems comprise synthetic transcription factors that are able to modulate, such as reduce or repress, transcription of a gene in a targeted manner. In provided embodiments, the provided epigenetic-modifying DNA-targeting system reduces transcription of the gene and/or regulatory element thereof or plurality of genes and/or regulatory element thereof, and thereby promotes silencing of HBV replication and/or transcription. The provided embodiments can be used to target multiple genetic mechanisms to treat HBV in infected patients, while avoiding the viral resistance, cost related to prolonged treatments, and poor efficacies of current combination therapies. This approach offers substantial clinical solutions to the treatment of HBV infections by reducing viral replication as well as transcription from both cccDNA and integrated HBV DNA, and circumventing the problems associated with current therapies.

All publications, including patent documents, scientific articles and databases, referred to in this application are incorporated by reference in their entirety for all purposes to the same extent as if each individual publication were individually incorporated by reference. If a definition set forth herein is contrary to or otherwise inconsistent with a definition set forth in the patents, applications, published applications and other publications that are herein incorporated by reference, the definition set forth herein prevails over the definition that is incorporated herein by reference.

The section headings used herein are for organizational purposes only and are not to be construed as limiting the subject matter described.

I. DNA-TARGETING SYSTEMS

In some embodiments, provided are DNA-targeting systems capable of specifically targeting a target site in at least one gene (also called a target gene herein) or DNA regulatory element thereof (e.g., regulatory element), and reducing transcription of the at least one gene. In provided embodiments, for each target gene or regulatory element thereof that is targeted, the DNA-targeting systems include a DNA-binding domain that binds to a target site in a gene or regulatory element thereof. In some embodiments, the DNA-targeting systems additionally include at least one effector domain that is able to epigenetically modify one or more DNA bases of the gene or regulatory element thereof, in which the epigenetic modification results in a reduction in transcription of the gene (e.g. inhibits transcription or reduces transcription of the gene compared to the absence of the DNA-targeting system). Hence, the terms DNA-targeting system and epigenetic-modifying DNA targeting system may be used herein interchangeably. In some embodiments, the DNA-targeting systems include a fusion protein comprising (a) at least one DNA-binding domain capable of being targeted to the target site; and (b) at least one effector domain capable of reducing transcription of the gene. For instance, the at least one effector domain is a transcription repressor domain.

In some embodiments, the DNA-targeting system contains at least one DNA-targeting module, where each DNA-targeting module of the system is a component of the DNA-targeting system that is independently capable of targeting one target site in a target gene or regulatory element thereof as provided. In some embodiments, each DNA-targeting module includes (a) a DNA-binding domain capable of being targeted to a target site of the target gene or regulatory element thereof that regulates HBV replication and/or HBV transcription and (b) an effector domain capable of reducing transcription of the gene.

In some embodiments, the DNA-targeting system includes a single DNA-targeting module for targeting repression of a single gene. In some embodiments, the DNA-targeting module includes (a) a DNA-binding domain capable of being targeted to a target site of the target gene or regulatory element thereof that regulates HBV replication and/or HBV transcription and (b) an effector domain capable of reducing transcription of the gene.

In some embodiments, the DNA-targeting system includes a single DNA-targeting module for targeting repression of more than one gene or regulatory element thereof. Hence, in some embodiments, the single DNA-targeting module provides for a multiplexed epigenetic-modifying DNA targeting system that targets for modulation (e.g. repression) more than one gene or regulatory element thereof. In some embodiments, the DNA-targeting module includes (a) a DNA-binding domain capable of being targeted to a target site of more than one target gene or regulatory element thereof that regulates HBV replication and/or HBV transcription and (b) an effector domain capable of reducing transcription of the gene. In some embodiments, the DNA-targeting system includes a single DNA-targeting module for targeting repression of at least 2, at least 3, at least 4, at least 5, at least 6, at least 7, at least 8, at least 9, at least 10, at least 20, at least 30 genes or regulatory elements thereof. In particular embodiments, the DNA-targeting module is cross-reactive to each of the target sites of the more than one gene. In some embodiments, the single DNA-targeting module provides a multiplexed epigenetic-modifying DNA targeting system that represses transcription of more than one gene or regulatory element thereof. In some embodiments, the DNA-targeting module represses transcription of at least 2, at least 3, at least 4, at least 5, at least 6, at least 7, at least 8, at least 9, at least 10, at least 20, at least 30 genes or regulatory elements thereof.

In some embodiments, the DNA-targeting systems are multiplexed DNA-targeting systems that include a plurality of DNA-targeting modules, in which each DNA-targeting module targets a different target site of one or more genes or regulatory elements thereof. In some embodiments, the different targets sites are in the same region of the gene or regulatory element thereof. In some embodiments, the different target sites are present in a regulatory element, such as a promoter. In some embodiments, the target sites overlap, such that any two or more DNA-targeting modules bind to overlapping target sites.

In some embodiments, the DNA-targeting system includes a plurality of DNA-targeting modules, in which each DNA-targeting module is for targeting repression of a different gene. In some embodiments, the DNA-targeting systems are multiplexed DNA-targeting systems, i.e. targeted to target sites in more than one gene or regulatory element thereof. The term DNA-targeting system may include a multiplexed epigenetic-modifying DNA targeting system that includes more than one DNA-targeting module. In some embodiments, each DNA-targeting module within the multiplexed epigenetic-modifying DNA targeting system targets a target site in a different gene or regulatory element thereof to each repress a different gene, from other DNA-targeting modules of the system. In some embodiments, each DNA-targeting module within the multiplexed epigenetic-modifying DNA targeting system targets a target site in more than one gene or regulatory element thereof to repress transcription of the more than one gene. In some embodiments, each DNA-targeting module represses transcription of at least 2, at least 3, at least 4, at least 5, at least 6, at least 7, at least 8, at least 9, at least 10, at least 20, at least 30 genes.

A multiplexed epigenetic-modifying DNA targeting system comprises at least 2, at least 3, at least 4, at least 5, at least 6, at least 7, at least 8, at least 9, at least 10, at least 20, at least 30 DNA-targeting modules or any value between any of the foregoing. In some embodiments, the multiplexed epigenetic-modifying DNA targeting system represses transcription of at least 2, at least 3, at least 4, at least 5, at least 6, at least 7, at least 8, at least 9, at least 10, at least 20, at least 30 genes.

In some embodiments, any two DNA-targeting modules of a DNA-targeting system comprise separate (i.e. non-overlapping) components. In some embodiments, each DNA-targeting modules of a DNA-targeting system comprise separate (i.e. non-overlapping) components. For example, a DNA-targeting system may comprise a first DNA-targeting module comprising a first fusion protein comprising a DNA-binding domain (e.g. a ZFN or TALE-based DNA-binding domain) that targets a first target site, and a second DNA-targeting module comprising a second fusion protein comprising a second DNA-binding domain (e.g. a ZFN or TALE-based DNA-binding domain) that targets a second target site.

In some embodiments, any two DNA-targeting modules of a DNA-targeting system may comprise shared (i.e. overlapping) components. In some embodiments, each DNA-targeting modules of a DNA-targeting system comprise shared (i.e. overlapping) components. For example, a DNA-targeting system may comprise a first DNA-targeting module comprising (a) a fusion protein comprising a Cas protein and a transcriptional repressor domain, and (b) a first gRNA that complexes with the Cas protein and targets a first target site of a first HBV gene or regulatory element thereof, and a second DNA-targeting module comprising (a) the fusion protein of the first DNA-targeting module, and (b) a second gRNA that complexes with the Cas protein and targets a second target site of a second HBV gene or regulatory element thereof. It will be understood that providing two or more different gRNAs for a given Cas protein allows different molecules of the same Cas protein to be targeted to the target sites of the two or more gRNAs. Conversely, different Cas protein variants (e.g., SpCas9 and SaCas9) are compatible with different gRNA scaffold sequences and PAMs, as described herein. Thus, it is possible to engineer a single DNA-targeting system comprising multiple non-overlapping CRISPR/Cas-based DNA-targeting modules.

In some aspects, provided herein is an epigenetic-modifying DNA-targeting system comprising a plurality of DNA-targeting modules for repressing transcription of a plurality of genes that regulate HBV replication and/or HBV transcription. In some embodiments, the plurality of DNA-targeting modules comprises a first DNA-targeting module for repressing transcription of a first gene of the plurality of genes or regulatory elements thereof, and a second DNA-targeting module for repressing transcription of a second gene of the plurality of genes. In some embodiments, each DNA-targeting module comprises a fusion protein comprising: (a) a DNA-binding domain for targeting to a target site of one of the plurality of genes, and (b) at least one transcriptional repressor domain. In some embodiments, the target site is at or near an HBV gene or a regulatory element thereof. In some embodiments, HBV gene or a regulatory element thereof is involved in controlling HBV replication and/or HBV transcription. The regulatory element may be a promoter region (e.g., pre-S1 promoter, a pre-S2 promoter, X promoter, or basal core promoter), enhancer region (e.g., Enh1 or an Enh2 enhancer region), or any other transcript processing control region (e.g., regions involved in 5'-capping, splicing, and/or 3' polyadenylation).

In some aspects, provided herein is an epigenetic-modifying DNA-targeting system comprising at least one DNA-targeting module for repressing transcription of one or more Hepatitis B viral (HBV) genes; wherein each of the at least one DNA-targeting module comprises a fusion protein comprising: (a) a DNA-binding domain for targeting to a target site in a Hepatitis B viral DNA sequence, such as an HBV gene or regulatory element thereof; and (b) at least one transcriptional repressor effector domain.

In some aspects, provided herein is an epigenetic-modifying DNA-targeting system comprising at least one DNA-targeting module for repressing transcription of one or more Hepatitis B viral (HBV) genes, wherein each of the at least one DNA-targeting module comprises: (a) a fusion protein comprising a Clustered Regularly Interspaced Short Palindromic Repeats associated (Cas) protein or variant thereof and at least one transcriptional repressor effector domain; and (b) a plurality of guide RNAs (gRNAs) targeting a plurality of target sites of a plurality of genes or regulatory elements thereof, wherein the plurality of genes or regulatory elements thereof regulate Hepatitis B virus replication and/or HBV transcription. In aspects of the provided embodiments, the plurality of target sites are 2, 3, 4, 5, or 6 different target sites. In aspects of the provided embodiments, the plurality of target sites are each in a different HBV gene or a regulatory element thereof.

In aspects of the provided embodiments, a DNA-targeting system provided herein targets a gene or regulatory element thereof to reduce transcription of one or more HBV genes in an Hepatitis B Virus (HBV) infected cell, in which the reduced transcription modulates one or more activities or functions of the HBV infected cells, such as expression of HBV RNA and/or HBV proteins. In some embodiments, reduced transcription of the gene results in a reduction in expression of the gene, i.e. reduced gene expression, in the infected cell. In some embodiments, reduced transcription of the gene, such as reduced gene expression, results in a reduction in expression of the protein, i.e. reduced protein expression, in the infected cell.

In some aspects, the cell is a liver cell, such as a hepatocyte, hepatic stellate cells (HSCs), kupffer cells, and liver sinusoidal endothelial cells. For instance, provided herein is a DNA-targeting system provided herein targets a gene or a regulatory element thereof to reduce transcription of the HBV gene in a target cell, in which the reduced transcription modulates one or more activities or functions of HBV, such as transcription and protein expression of HBV. In some embodiments, reduced transcription of the gene results in a reduction in expression of the gene, i.e. reduced gene expression, in the target cell. In some aspects the cell is a liver cell.

In some aspects, the cell is from a human subject. In some aspects the cell is a cell in a subject (i.e. a cell in vivo).

In some embodiments, the DNA-binding domain comprises or is derived from a CRISPR associated (Cas) protein, zinc finger protein (ZFP), transcription activator-like effectors (TALE), meganuclease, homing endonuclease, I-SceI enzyme, or variants thereof. In some embodiments, the DNA-binding domain comprises a catalytically inactive (e.g. nuclease-inactive or nuclease-inactivated) variant of any of the foregoing. In some embodiments, the DNA-binding domain comprises a deactivated Cas9 (dCas9) protein or variant thereof that is a catalytically inactivated so that it is inactive for nuclease activity and is not able to cleave the DNA.

In some embodiments, the DNA-binding domain comprises or is derived from a Cas protein or variant thereof such as a nuclease-inactive Cas or dCas (e.g. dCas9, and the DNA-targeting system comprises one or more guide RNAs (gRNAs), such as a combination of gRNAs (e.g. two gRNAs or three gRNAs). In some embodiments, the gRNA comprises a spacer sequence that is capable of targeting and/or hybridizing to the target site. In some embodiments, the gRNA is capable of complexing with the Cas protein or variant thereof. In some aspects, the gRNA directs or recruits the Cas protein or variant thereof to the target site. In some embodiments, the effector domain comprises a transcription repressor domain, and/or is capable of reducing transcription of the gene. In some embodiments, the effector domain directly or indirectly leads to reduced transcription of the gene. In some embodiments, the effector domain induces, catalyzes or leads to transcription repression. In some embodiments, the effector domain induces transcription repression. In some aspects, the effector domain is selected from a KRAB domain, ERF repressor domain, MXI1 domain, SID4X domain, MAD-SID domain, a DNMT family protein domain (e.g. DNMT3A or DNMT3B), a fusion of one or more DNMT family proteins or domains thereof (e.g. DNMT3A/L, which comprises a fusion of DNMT3A and DNMT3L domains), LSD1, a SunTag domain, an EZH2 domain, a partially or fully functional fragment or domain of any of the foregoing, or a combination of any of the foregoing. In some embodiments, the effector domain is KRAB. In some embodiments, the effector domain is DNMT3A/L.

In some embodiments, the fusion protein of the DNA-targeting system comprises a dCas9-KRAB fusion protein. In some embodiments, the fusion protein of the DNA-targeting system comprises a DNMT3A/L-dCas9-KRAB-fusion protein. In some embodiments, the fusion protein of the DNA-targeting system comprises a KRAB-dCas9-DNMT3A/L-fusion protein.

Exemplary components and features of the DNA-targeting systems are provided below in the following subsections.

A. Target Sites and Target Positions

In any of the embodiments herein, the target site is a gene and/or regulatory element thereof in the Hepatitis B viral (HBV) genome. In some embodiments, the target site is present in a covalently closed circular DNA (cccDNA), relaxed circular DNA (rcDNA) and/or is integrated in the human genomic DNA. In some embodiments, the target site in a Hepatitis B viral DNA sequence. In some embodiments, the Hepatitis B viral DNA sequence is an HBV gene or a regulatory element thereof. In some embodiments, the target site is at or near a gene involved in HBV replication and/or HBV transcription. In some embodiments, the epigenetic-modifying DNA-targeting system comprises at least one DNA-targeting module for repressing transcription of one or more HBV by targeting to the target site. In some aspects, repressing transcription of the HBV gene, such as reduced gene expression, results in silencing of HBV replication (e.g., reduced HBV replication) and/or HBV transcription.

With reference to the provided disclosure, it is understood that a cell that is positive (+) for HBV (e.g., HBV infected cell) means that the cell expresses any of the HBV markers (e.g., HBV RNA transcripts and/or proteins) described herein. Likewise, it is understood that a cell that is negative (−) for a particular marker is a cell that does not express the marker at a level that is not detectable. Antibodies and other binding entities can be used to detect expression levels of marker proteins to identify or detect a given cell surface marker. Suitable antibodies may include polyclonal, monoclonal, fragments (such as Fab fragments), single chain antibodies and other forms of specific binding molecules. Antibody reagents for cell surface markers above are readily known to a skilled artisan. A number of well-known methods for assessing expression level of surface markers or proteins may be used, such as detection by affinity-based methods, e.g., immunoaffinity-based methods, e.g., in the context of surface markers, such as by flow cytometry. In some embodiments, the label is a fluorophore and the method for detection or identification of cell surface markers on cells (e.g. hepatocytes) is by flow cytometry. In some embodiments, different labels are used for each of the different markers by multicolor flow cytometry. In some embodiments, surface expression can be determined by flow cytometry, for example, by staining with an antibody that specifically binds to the marker and detecting the binding of the antibody to the marker.

In some embodiments, a cell (e.g. hepatocyte) is positive (pos or +) for a particular marker if there is detectable presence on or in the cell of a particular marker, which can be an intracellular marker or a surface marker (e.g., HBeAg, HBsAg). In some embodiments, surface expression is positive if staining by flow cytometry is detectable at a level substantially above the staining detected carrying out the same procedures with an isotype-matched control under otherwise identical conditions and/or at a level substantially similar to, or in some cases higher than, a cell known to be positive for the marker and/or at a level higher than that for a cell known to be negative for the marker. In some embodiments, a cell (e.g. a hepatocyte) contacted by a DNA-targeting system described herein, has decreased expression for a particular marker (e.g. HBeAg) if the staining is substantially lower than a similar cell that was not contacted by the DNA-targeting system.

In some embodiments, a cell (e.g. hepatocyte) is negative (neg or −) for a particular marker if there is an absence of detectable presence on or in the cell of a particular marker, which can be an intracellular marker or a surface marker. In some embodiments, surface expression is negative if staining is not detectable by flow cytometry at a level substantially above the staining detected carrying out the same procedures with an isotype-matched control under otherwise identical conditions and/or at a level substantially lower than a cell known to be positive for the marker and/or at a level substantially similar to a cell known to be negative for the marker.

In some embodiments, the phenotype of infected cells and/or individuals is characterized functionally. In some aspects, the phenotype can be characterized by the presence of HBV RNA transcripts in infected cells. In some aspects, the phenotype can be characterized by the presence of any one or combination of the HBV proteins in infected cells. In some aspects, the phenotype can be characterized by the presence of antibodies to any of the markers described herein. In some aspects, the antibodies include but are not limited to anti-HBc-IgM, anti-HBc total, and antibodies to HBeAg. In some embodiments, the RNA transcripts, proteins and/or antibodies are measured, detected, and/or quantified by any suitable technique known in the art. For instance, the RNA transcripts may be measured, detected and/or quantified using real-time PCR techniques. The HBV proteins (e.g., HBsAg, HBeAg and/or HBcrAg) may be measured, detected and/or quantified using enzyme-linked immunosorbent assays (ELISAs).

The target genes and/or regulatory elements thereof for modulation by the provided DNA-targeting systems, including multiplexed epigenetic-modifying DNA-targeting systems herein, include any whose transcription and expression are reduced in cells (e.g., HBV infected cells). Various methods may be utilized to characterize the transcription or expression levels of a gene in a cell (e.g. hepatocyte) such as after the cell has been contacted or introduced with a provided DNA-targeting system. In some embodiments, analyzing the transcription activity or expression of a gene may be by RNA analysis. In some embodiments, the RNA analysis includes RNA quantification. In some embodiments, the RNA quantification occurs by reverse transcription quantitative PCR (RT-qPCR), multiplexed qRT-PCR, fluorescence in situ hybridization (FISH), RNA-sequencing (RNA-seq) or combinations thereof.

In some embodiments, the gene or transcript is one in which expression of the gene or presence of the transcript in the cell (e.g. HBV infected cell, such as a hepatocyte), is reduced after having been contacted or introduced with a provided DNA-targeting system, such as a multiplexed epigenetic DNA-targeting system. In some aspects, a plurality of genes or transcripts are targeted by a multiplexed epigenetic DNA-targeting system, such as by one or more DNA-targeting modules thereof. In such system, each gene or transcript of a multiplexed DNA-targeting system is one in which expression of the gene or presence of the transcript in the cell is reduced after having been contacted or introduced with a provided multiplexed epigenetic DNA targeting system. In some embodiments, the reduction in gene expression or the change in the level of transcripts in a cell (e.g. HBV infected cell, such as a hepatocyte) is about a log 2 fold change of at least 1.25-fold, 1.5-fold, 1.75-fold, 2.0-fold, 2.5-fold, 2.75-fold, 3.0-fold, 3.25-fold, 3.5-fold, 3.75-fold, 4.0 fold, 4.25-fold, 4.5-fold, 4.75-fold, 5.0-fold, 5.25-fold, 5.5-fold, 5.75-fold, 6.25-fold, 6.50-fold, 6.75-fold, 7.0-fold. 7.25-fold, 7.50-fold, 7.75-fold, 8.0-fold, 8.25-fold, 8.5-fold, 8.75-fold, 9.0-fold or any value between any of the foregoing compared to the level of the gene in a control cell. In some embodiments, the reduction in gene expression or the change in the level of transcripts in a cell (e.g. HBV infected cell, such as a hepatocyte) is about 10%, about 20%, about 30%, about 40%, about 50%, about 60%, about 70%, about 80%, about 90%, about 100% or any value between any of the foregoing compared to the level of gene in a control cell. In some embodiments, the reduction in gene expression or the change in the level of transcripts in a cell is greater than 90% compared to the level of gene in a control cell. In some embodiments, the guide RNAs are set forth in SEQ ID NOs:565, 528, 542, 508, 515, 575, 515, 453, 506, 514, 425, or 472. In some embodiments, the reduction in gene expression or the change in the level of transcripts in a cell is greater than 75% compared to the level of gene in a control cell. In some embodiments, the guide RNAs are set forth in SEQ ID NOS: 565 (HBVg_175), 528 (HBVg_138), 582 (HBVg_192), 542 (HBVg_152), 508 (HBVg_118), 515 (HBVg_125), 575 (HBVg_185), 453 (HBVg_63), 506 (HBVg_116), 514 (HBVg_124), 395 (HBVg_5), 472 (HBVg_82), 451 (HBVg_61), 488 (HBVg_98), 540 (HBVg_150), 533 (HBVg_143), 572 (HBVg_182), 566 (HBVg_176), 489 (HBVg_99), 469 (HBVg_79), 408 (HBVg_18), 465 (HBVg_75), 402 (HBVg_12), 474 (HBVg_84), 525 (HBVg_135), 416 (HBVg_26), 396 (HBVg_6), 554 (HBVg_164), 419 (HBVg_29), 545 (HBVg_155), 446 (HBVg_56), 580 (HBVg_190), 555 (HBVg_165), 412 (HBVg_22), 428 (HBVg_38), 458 (HBVg_68), 548 (HBVg_158), 511 (HBVg_121), 432 (HBVg_42), 441 (HBVg_51), 433 (HBVg_43), 579 (HBVg_189), 479 (HBVg_89), 478 (HBVg_88), 520 (HBVg_130), 462 (HBVg_72), 523 (HBVg_133), and 503 (HBVg_113).

In provided embodiments, the cccDNA transcribes five HBV RNAs (0.7 kb, 2.1 kb, 2.4 kb, longer and shorter 3.5 kb RNAs) under the host RNA polymerase. Transcription of cccDNA is controlled by four promoters-the basal core, preS1, preS2, and X promoters and two enhancers—enhancers I and II (FIG. 1). The 0.7-kb RNA can be translated to HBV X protein (HBx) which acts as a transcriptional regulator. The 2.1-kb RNA can be translated to HBV small surface protein (S) and middle surface protein (M). The 2.4-kb RNA can be translated to HBV large surface protein (L). L, M, and S can self-assemble to form empty subviral particles (SVPs) (including spherical SVPs and filamentous SVPs) that are secreted with only filamentous SVPs and virions containing significant amounts of L protein. The spherical SVPs are secreted through the constitutive secretory pathway. The filamentous SVPs are secreted by the endosomal sorting complex required for transport (ESCRT) machinery through multivesicular bodies (MVB). The longer 3.5-kb RNA is termed pre-core RNA (preC RNA) and can be translated to pre-Core protein, better known as HBV e antigen (HBeAg). The shorter 3.5-kb RNA is pre-genomic RNA (pgRNA) that has two roles, as the translation template for HBV polymerase (Pol) and Core proteins and as the replication template for intra-capsid (formed by Core protein polymerization) reverse transcription by Pol to form HBV rcDNA. These nucleocapsids can then be enveloped by HBV surface proteins (L, M, and S) to form mature virions and secreted through the ESCRT/MVB pathway. Alternatively, these nucleocapsids can also be transported to the nucleus to form cccDNA. In some embodiments, repressing transcription and/or translation of the HBV gene, such as reduced gene expression, results in silencing of any of the following HBV markers: HBV HBV X protein (HBx), Hepatitis B surface antigens (HBsAg) such as small surface protein (S), middle surface protein (M), or HBV large surface protein (L), HBV e antigen (HBeAg). In some embodiments, repressing transcription and/or translation of the HBV gene, such as reduced gene expression, results in silencing of HB core-related antigens (HBcrAg). HBcrAg includes 3 precore/core protein products, including hepatitis B core antigen (HBcAg), HBeAg, and a 22-kDA precore protein (p22cr). In some aspects, cccDNA, HBV total DNA, serum HBcrAg, HBsAg, HBeAg, hepatitis B core antibody (anti-HBc), HBV DNA, HBV RNA are quantified as readouts for measuring reduced HBV transcription and/or translation. In some embodiments, the target site is in a gene that encodes any of the HBV proteins. In some embodiments, the target site is in a regulatory element (e.g. promoter or enhancer) of a gene that encodes any of the HBV proteins.

In some embodiments, the target site for an epigenetic-modifying DNA-targeting system is in a gene involved in HBV replication and/or HBV transcription. In some aspects, the target site for an epigenetic-modifying DNA-targeting system is in or near a gene or a regulatory element thereof involved in controlling HBV replication and/or HBV transcription. In some embodiments, the gene involved in HBV replication and/or HBV transcription is a polymerase gene, a S-family gene, a X-gene, and/or a core-family gene. In some embodiments, the gene involved in HBV replication and/or transcription encodes a polymerase, an envelope protein, capsid protein, transcription factor, or transcriptional transactivator. In some embodiments, the regulatory element thereof involved in HBV replication and/or HBV transcription is a promoter region, an enhancer region, and/or any transcript processing control region. In some embodiments, the promoter region is a pre-S1 promoter, a pre-a S2 promoter, a X promoter, or a basal core promoter. In some embodiments, the enhancer region is an Enh1 enhancer and/or an Enh2 enhancer region. In some embodiments, the transcript processing control region is a region that encodes signals for 5'-end capping, splicing, and/or 3'-end polyadenylation.

In some embodiments, the target site is a sequence within a target region that has a sequence corresponding to the sequence positioned between base pair (bp) positions: 1 bp-42 bp, 491 bp-1032 bp, 1750 bp-1799 bp, or 1951 bp-2952 bp of the HBV genome with reference to the Hepatitis B Virus genome (Hepatitis B virus subtype ayw, complete genome, GenBank: U95551.1), SEQ ID NO 650. In some embodiments, the target site is within a target region of the HBV genome in which the target region has the sequence set forth in SEQ ID NO: 1056 or is a complementary sequence thereof. In some embodiments, the target site is within a target region of the HBV genome in which the target region has the sequence set forth in SEQ ID NO: 1058 or is a complementary sequence thereof. In some embodiments, the target site is within a target region of the HBV genome in which the target region has the sequence set forth in SEQ ID NO: 1060 or is a complementary sequence thereof. In some embodiments, the target site is within a target region of the HBV genome in which the target region has the sequence set forth in SEQ ID NO: 1062 or is a complementary sequence thereof.

In some embodiments, the target site is a sequence within a target region that has a sequence corresponding to the sequence positioned between base pair (bp) positions: 43 bp-490 bp, 1033 bp-1749 bp, 1800 bp-1950 bp, or 2953 bp-3182 bp of the HBV genome with reference to the Hepatitis B Virus genome (Hepatitis B virus subtype ayw, complete genome, GenBank: U95551.1), SEQ ID NO: 650. In some embodiments, the target site is within a target region of the HBV genome in which the target region has the sequence set forth in SEQ ID NO: 1057 or is a complementary sequence thereof. In some embodiments, the target site is within a target region of the HBV genome in which the target region has the sequence set forth in SEQ ID NO: 1059 or is a complementary sequence thereof. In some embodiments, the target site is within a target region of the HBV genome in which the target region has the sequence set forth in SEQ ID NO: 1061 or is a complementary sequence thereof. In some embodiments, the target site is within a target region of the HBV genome in which the target region has the sequence set forth in SEQ ID NO: 1063 or is a complementary sequence thereof.

In some embodiments, the target site is a sequence within a target region that has a sequence corresponding to the sequence positioned between base pair (bp) positions: 67 bp-392 bp (CpG Island 1), 1033 bp-1749 bp (CpG Island 2), or 2215 bp-2490 bp (CpG Island 3) of the HBV genome with reference to the Hepatitis B Virus genome (Hepatitis B virus subtype ayw, complete genome, GenBank: U95551.1), SEQ ID NO: 650. In some embodiments, the target site is within a target region of the HBV genome in which the target region has the sequence set forth in SEQ ID NO: 1064 or is a complementary sequence thereof. In some embodiments, the target site is within a target region of the HBV genome in which the target region has the sequence set forth in SEQ ID NO: 1059 or is a complementary sequence thereof. In some embodiments, the target site is within a target region of the HBV genome in which the target region has the sequence set forth in SEQ ID NO: 1066 or is a complementary sequence thereof.

In some embodiments, the target site is in a polymerase gene or a regulatory element thereof. The polymerase gene (also known as P gene) encodes a multifunctional enzyme (also known as P polymerase, HBVgp1, DNA-directed DNA polymerase) that converts the viral RNA genome into dsDNA in viral cytoplasmic capsids. The polymerase displays a DNA polymerase activity that can copy either DNA or RNA templates, and a ribonuclease H (RNase H) activity that cleaves the RNA strand of RNA-DNA heteroduplexes in a partially processive 3'- to 5'-endonucleasic mode. The polymerase gene ORF completely overlaps with the preS/S ORF and partially overlaps with the core family and X gene ORFs. In some embodiments, the target site is a sequence within a target region that has a sequence corresponding to the sequence positioned between 1 bp-1621 bp, 1374 bp-1838 bp or 2307 bp-3182 bp of the HBV genome with reference to the Hepatitis B Virus genome (Hepatitis B virus subtype ayw, complete genome, GenBank: U95551.1), SEQ ID NO: 650.

In some embodiments, the target site is in an S-family gene or a regulatory element thereof. In some embodiments, the target site is in the S gene, pre-S1 promoter, and/or pre-S2 promoter regions. The S-family genes encode three different structurally related envelope proteins, which are synthesized from alternative initiation codons are are termed Large (L), Middle (M), and Small (S) Hepatitis B (HB) proteins (also refered to as L-HBs, M-HBs, and s-HBs, respectively). The three proteins share the same carboxy-terminus but have different amino-terminal extenstions. In some embodiments, the target site is a sequence within a target region that has a sequence corresponding to the sequence positioned between 1 bp-837 bp, 1 bp-155 bp or 2854 bp-3182 bp of the HBV genome with reference to the Hepatitis B Virus genome (Hepatitis B virus subtype ayw, complete genome, GenBank: U95551.1), SEQ ID NO: 650.

In some embodiments, the target site is in an X-gene or regulatory element thereof. The X-gene (also known as HBx, HBVgp3, peptide X, pX) is a gene that encodes a multifunctional protein that modulates transcriptional regulation, protein degradation pathways, apoptosis, signal transduction, cell cycle progress, and genetic stability by directly or indirectly interacting with host factors. The X-gene protein modulates protein degradation pathways, apoptosis, transcription, signal transduction, cell cycle progress, and genetic stability by directly or indirectly interacting with host factors. In some embodiments, the target site is a sequence within a target region that has a sequence corresponding to the sequence positioned between 1374 bp-1838 bp of the HBV genome with reference to the Hepatitis B Virus genome (Hepatitis B virus subtype ayw, complete genome, GenBank: U95551.1), SEQ ID NO: 650. In some embodiments, the start codon for encoding the HBx protein (HBx start codon) is at residue base pair 1376 of the HBV genome corresponding to positions with reference to the HBV genome set forth in SEQ ID NO: 650. In some embodiments, the start codon for encoding the HBx protein (HBx start codon) is at residue base pair 1374 of the HBV genome corresponding to positions with reference to the HBV genome set forth in SEQ ID NO: 1071. It is found herein that targeting a target site in the X-gene in this region upstream of the start codon using a provided epigenetic-modifying DNA targeting system exhibits high activity for repressing viral replication and transcription of HBV infected cells. In some embodiments, the target region is in a CpG island of the HBV genome. In some embodiments, the target site is a sequence within a target region that has a sequence corresponding to the sequence positioned between 1033-1749 bp with reference to the HBV genome set forth in SEQ ID NO:650. In some embodiments, the target site is in the HBx promoter/Enhancer #1 region, such as within a target region that has a sequence corresponding to the sequence positioned between between 1100-1350 bp with reference to the HBV genome set forth in SEQ ID NO: 650. In some embodiments, the target site is in the basal core promoter region, such as within a target region that has a sequence corresponding to the sequence positioned between 1600-1750 bp with reference to the HBV genome set forth in SEQ ID NO: 650.

In some embodiments, the target site is within a target region spanning within 300 base pairs (bp), within 250 bp, within 200 bp, within 150 bp, within 140 bp, within 130 bp, within 120 bp, within 110 bp or within 100 bp upstream of the HBx start codon. In some embodiments, the target site is within a target region that has a sequence corresponding to the sequence positioned between 1250-1374 bp with reference to the HBV genome set forth in SEQ ID NO: 650. In some embodiments, the target site is within a target region of the HBV genome in which the target region has the sequence set forth in SEQ ID NO: 1068 or is a complementary sequence thereof. In some embodiments, the target site is a sequence within a target region that has a sequence corresponding to the sequence positioned between 1255-1302 bp with reference to the HBV genome set forth in SEQ ID NO: 650. In some embodiments, the target site is within a target region of the HBV genome in which the target region has the sequence set forth in SEQ ID NO: 1069 or is a complementary sequence thereof. In some embodiments, the target site is a sequence within a target region that has a sequence corresponding to the sequence positioned between 1260-1300 bp with reference to the HBV genome set forth in SEQ ID NO: 650. In some embodiments, the target site is within a target region of the HBV genome in which the target region has the sequence set forth in SEQ ID NO: 1070 or is a complementary sequence thereof. In some embodiments, the target site, or each of the target sites, is within a target region located at base pairs between 1060-1480 bp of the HBV genome corresponding to positions with reference to the HBV genome set forth in SEQ ID NO: 650. In some embodiments, the target site is within a target region of the HBV genome in which the target region has the sequence set forth in SEQ ID NO: 1067. Exemplary DNA-binding systems for targeting targets sites in such regions are provided herein, including systems with various DNA-binding domains including CRISPR/Cas systems and ZFPs.

In some embodiments, the target site is in a core family gene or regulatory element thereof. In some embodiments, the regulatory element thereof is an Enh2 promoter. In some embodiments, the regulatory element thereof is basal core promoter (BCP). The core promoter (CP) region of the viral genome has a pivot role in replication and morphogeneis of the virus (Quarleri J, World Journal of Gastroenterology 20(2): 425-435 (2014)). The core promoter region directs initiation of transcriptions for the synthesis of both the precore mRNA and pre-genomic RNA (pgRNA). The CP region consists of the basal core promoter (BCP), which initiates pre-core mRNA (also known as preC, C gene, HBVgp4) and pgRNA transcription, and consists of an upper regulatory region (URR), which contains positive and negative regulatory elements that modulate promoter activity. Several transcriptional factors bind to regulatory sequence elements of the CP, such as C/EBP, HNF1, HNF3/4, COUP-TF1 to differentially regulate synthesis of pre-C mRNA and pgRNA. The presence of AT-rich regions or TATA-like boxes within the CP are also attributed to transcription of pgRNA. The pre-core mRNA encodes an external core antigen (also known as capsid protein, pre-capsid protein, HBeAg, precore protein, p25) that self-assembles to form an icosahedral capsid that packages the viral genome. The pgRNA is translated to form the polymerase, nucleocapsid protein HBcAg, and the soluble secreted HBeAg proteins. The pgRNA is additionally incorporated into progeny nucleocapsids and reverse transcribed into DNA by the co-assembled viral polymerase into new HBV virions. These mature relaxed circular DNA (rcDNA)-containing nucleocapsids can either redeliver their genomes to the nucleus of the same cell to build a pool of 10-100 copied of cccDNA molecules or can interact with the envelope proteins at the ER/Golgi and can be secreted as new infectious virions (Pollicino T., et al., Journal of hepatology, 61(2):P408-417 (2014)). In some embodiments, the target site is in a core family gene or regulatory element thereof. In some aspects, targeting one or more sites within the core family gene or regulatory element thereof comprises repression of the pgRNA transcript. In some aspects, repression of the pgRNA transcript comprises silencing of HBV replication. In some embodiments, the target site is a sequence within a target region that has a sequence corresponding to the sequence positioned between 1590 bp-1815 bp, 1636 bp-1744, 1751 bp-1769, 1814 bp-1900 bp, 1816 bp-2455, 1800 bp-1950 bp of the HBV genome with reference to the Hepatitis B Virus genome (Hepatitis B virus subtype ayw, complete genome, GenBank: U95551.1), SEQ ID NO: 650. In some embodiments, reduced transcription comprises a reduction in total Hepatitis B viral RNA transcript levels. In some embodiments, reduced transcription comprises a reduction in Hepatitis B pre-core ("preC") and/or pre-genomic ("pgRNA") RNA levels.

In some aspects, the target site is a coding region. In some embodiments, the gene involved in HBV replication and/or HBV transcription encodes an HBV X protein (HBx), S family proteins (HBsAg) such as the small surface protein (S-HBs), middle surface protein (M-HBs), or HBV large surface protein (L-HBs), pre-core protein (HBeAg), HBV core-related antigen (HBcrAg), polymerase, core and pre-core proteins. In some aspects, the target site is a sequence within a target region that has a sequence corresponding to the sequence positioned between 1 bp-42 bp, 43 bp-1090 bp, 1091 bp-1849 bp, or 1850 bp-2455 bp or 2455 bp-3182 bp of the HBV genome with reference to the Hepatitis B Virus genome (Hepatitis B virus subtype ayw, complete genome, GenBank: U95551.1), SEQ ID NO: 650.

In some embodiments, repressing transcription comprises a reduction in Hepatitis B surface antigen (HBsAg) and/or Hepatitis B viral core-related-antigen (HBcrAg) protein levels. In some embodiments, repressing transcription comprises a reduction in HBsAg transcript and/or protein levels by at least 90%. In some embodiments, repressing transcription comprises a reduction in HBcrAg transcript and/or protein levels by at least 50% from the cccDNA.

In some embodiments, repressing transcription comprises a reduction in Hepatitis B pre-core ("preC"), pre-genomic ("pgRNA"), preS1, preS2/S, and HBx levels.

In some embodiments, the multiplexed epigenetic-modifying DNA-targeting system targets to or binds to a target site in the gene, such as any described above. In some embodiments, the target site is located in a regulatory DNA element of the gene in the cell (e.g. hepatocyte). In some embodiments, a regulatory DNA element is a sequence to which a gene regulatory protein may bind and affect transcription of the gene. In some embodiments, the regulatory DNA element is a cis, trans, distal, proximal, upstream, or downstream regulatory DNA element of a gene. In some embodiments, the regulatory DNA element is a promoter or enhancer of the gene. In some embodiments, the target site is located within a promoter, enhancer, exon, intron, untranslated region (UTR), 5' UTR, or 3' UTR of the gene. In some embodiments, a promoter is a nucleotide sequence to which RNA polymerase binds to begin transcription of the gene. In some embodiments, a promoter is a nucleotide sequence typically located between 100 bp and 1000 bp of a transcription start site of a gene, such as within about 100 bp, about 500 bp, about 1000 bp of a transcriptional start site of the gene. In some embodiments the target site is located within a sequence of unknown or known function that is suspected of being able to control expression of a gene.

In some embodiments, the target site is located within about 50 base pairs (bp), about 100 bp, about 150 bp, about 200 bp, about 250 bp, about 300 bp, about 350 bp, about 400 bp, about 450 bp, about 500 bp, about 600b p, about 650 bp, about 700 bp, about 750 bp, about 800 bp, about 850 bp, about 900 bp, about 1000 bp, about 1050 bp, about 1100 bp, about 1200 bp, about 1250 bp, about 1300 bp, about 1350 bp about 1400 bp, about 1450 bp, about 1500 bp, of a transcription start site.

In some embodiments, the target site is positioned within a target region that is located at base pairs between 1 bp-3300 bp of the HBV genome. In some embodiments, the target site is a sequence within a target region that has a sequence corresponding to the sequence positioned between 43 bp-490 bp, 1033 bp-1749 bp, 1800 bp-1950 bp, or 2953 bp-3182 of the HBV genome with reference to the Hepatitis B Virus genome (Hepatitis B virus subtype ayw, complete genome, GenBank: U95551.1), SEQ ID NO 650. In some embodiments, the target site is a sequence within a target region that has a sequence corresponding to the sequence positioned between 1 bp-42 bp, 491 bp-1032 bp, 1750 bp-1799 bp, or 1951 bp-2952 bp or 3198 bp-3182 bp of the HBV genome with reference to the Hepatitis B Virus genome (Hepatitis B virus subtype ayw, complete genome, GenBank: U95551.1), SEQ ID NO 650. According to phylogenetic analyses and sequence divergence, HBV can be classified into 10 genotypes (A to J) based upon an inter-group divergence of 8 percent or more in the complete nucleotide sequence (Norder H, et.a., Complete genomes, phylogenetic relatedness, and structural proteins of six strains of the hepatitis B virus, four of which represent two new genotypes. Virology. 1994 February; 198(2):489-503; Stuyver L, et.al., A new genotype of hepatitis B virus: complete genome and phylogenetic relatedness. J Gen Virol. 2000 January; 81(Pt 1):67-74, Arauz-Ruiz P, et.al., Genotype H: a new Amerindian genotype of hepatitis B virus revealed in Central America. J Gen Virol. 2002 August; 83(Pt 8):2059-2073)). There is evidence suggesting that HBV genotypes influence clinical outcomes, mutational patterns in the precore and core promoter regions, HbeAg seroconversion rates, and response to interferon therapy. Most genotypes have specific geographic distributions; genotypes A and D are prevalent in Western Europe and North America, and genotypes B and C are prevalent in East Asia and Oceania.

In some embodiments, the target site is at least 70% homologous to all Hepatitis B viral genotypes (e.g., genomes). In some embodiments, the target site is at least 70% homologous to at least 500, at least 1000, at least 1500, at least 2000, at least 2500, at least 3000, at least 3500, at least 4000, at least 4500, at least 5000, at least 5500, at least 6000, at least 6500, at least 7000 Hepatitis B viral genomes.

In some embodiments, the target site is at least 70% homologous to at least 1000 Hepatitis B viral genomes and comprises up to two mismatches. In some embodiments, the target site comprises the sequence set forth in any one of SEQ ID NOS: 1-195, a contiguous portion thereof of at least 14 nucleotides (nt) of any one of SEQ ID NOS: 1-195, or a complementary sequence of any of the foregoing. In some embodiments, the target site is a contiguous portion of any one of SEQ ID NOS: 1-195 that is 15, 16, 17, 18 or 19 nucleotides in length, or a complementary sequence of any of the foregoing. In some embodiments, the target site is a sequence having at or at least 80%, 85%, 90%, 91%, 92%, 93%, 94%, 95%, 96%, 97%, 98%, 99%, 99.5%, 99.9%, or 100% sequence identity to all or a contiguous portion of a target site sequence described herein above. In some embodiments, the target site is the sequence set forth in any one of SEQ ID NOS: 1-195.

In some of any embodiments, that target site is a sequence of 14 to 22 nucleotides. In some of any embodiments, that target site is a sequence of 14 to 19 nucleotides. In some of any embodiments, that target site is a sequence of 14 nucleotides. In some of any embodiments, that target site is a sequence of 15 nucleotides. In some of any embodiments, that target site is a sequence of 16 nucleotides. In some of any embodiments, that target site is a sequence of 17 nucleotides. In some of any embodiments, that target site is a sequence of 18 nucleotides. In some of any embodiments, that target site is a sequence of 19 nucleotides.

In any of the embodiments provided herein, the target site is complementary to a referenced sequence (i.e. particular sequence set forth by SEQ ID NO with reference to the Sequence Listing). In some of any embodiments, a complementary sequence is a reverse complement of the referenced sequence.

In any of the embodiments provided herein, the target site comprises the referenced sequence (i.e. particular sequence set forth by SEQ ID NO with reference to the Sequence Listing). In any of the embodiments provided herein, the target site is the sequence set forth by the referenced sequence (i.e. particular sequence set forth by SEQ ID NO with reference to the Sequence Listing).

In any of the embodiments provided herein, the target site is a contiguous portion of at least 14 nucleotides (14 nt) of a referenced sequence (i.e. particular sequence set forth by SEQ ID NO with reference to the Sequence Listing). In some embodiments, the contiguous portion is 15 nucleotides. In some embodiments, the contiguous portion is 16 nucleotides. In some embodiments, the contiguous portion is 17 nucleotides. In some embodiments, the contiguous portion is 18 nucleotides. In some embodiments, the contiguous portion is 19 nucleotides.

In some embodiments, the target site is at least 90% homologous to all Hepatitis B viral genomes. In some embodiments, target site is at least 90% homologous to at least 500, at least 1000, at least 1500, at least 2000, at least 2500, at least 3000, at least 3500, at least 4000, at least 4500, at least 5000, at least 5500, at least 6000, at least 6500, at least 7000 Hepatitis B viral genomes.

In some embodiments, the target site is at least 90% homologous to at least a 1000 Hepatitis B viral genomes and comprises one or two mismatches. In some embodiments, the target site comprises the sequence set forth in any one of SEQ ID NOS: 35-100, a contiguous portion thereof of at least 14 nt of any one of SEQ ID NOS: 35-100, or a complementary sequence of any of the foregoing. In some embodiments, the target site is a contiguous portion of any one of SEQ ID NOS: 35-100 that is 15, 16, 17, 18 or 19 nucleotides in length, or a complementary sequence of any of the foregoing. In some embodiments, the target site is a sequence having at or at least 80%, 85%, 90%, 91%, 92%, 93%, 94%, 95%, 96%, 97%, 98%, 99%, 99.5%, 99.9%, or 100% sequence identity to all or a contiguous portion of a target site sequence described herein above. In some embodiments, the target site is the sequence set forth in any one of SEQ ID NOS: 35-100.

In some embodiments, the mismatches are located in the first 12 nt on the 5' end of the protospacer adjacent motif (PAM) as represented by 'n' in 'nnnnnnnnnnnnNNNNNNNN-NGG'.

In some embodiments, the target site is at least 90% homology to at least 1000 Hepatitis B viral genomes and comprises zero mismatches. In some embodiments, the target site comprises the sequence set forth in any one of SEQ ID NOS: 1-34, a contiguous portion thereof of at least 14 nt of any one of SEQ ID NOS: 1-34, or a complementary sequence of any of the foregoing. In some embodiments, the target site is a contiguous portion of any one of SEQ ID NOS: 1-34 that is 15, 16, 17, 18 or 19 nucleotides in length, or a complementary sequence of any of the foregoing. In some embodiments, the target site is a sequence having at or at least 80%, 85%, 90%, 91%, 92%, 93%, 94%, 95%, 96%, 97%, 98%, 99%, 99.5%, 99.9%, or 100% sequence identity to all or a contiguous portion of a target site sequence described herein above. In some embodiments, the target site is the sequence set forth in any one of SEQ ID NOS: 1-34.

In any of the embodiments herein, the target site, or each of the target sites, comprises the sequence set forth in any one of SEQ ID NOS: 175, 138, 192, 152, 118, 125, 185, 63, 116, 124, 35, 82, a contiguous portion thereof of at least 14 nucleotides (nt), or a complementary sequence of any of the foregoing. In some embodiments, the target site is a contiguous portion of any one of SEQ ID NOS: 175, 138, 192, 152, 118, 125, 185, 63, 116, 124, 35, 82, that is 15, 16, 17, 18 or 19 nucleotides in length, or a complementary sequence of any of the foregoing. In some embodiments, the target site is a sequence having at or at least 80%, 85%, 90%, 91%, 92%, 93%, 94%, 95%, 96%, 97%, 98%, 99%, 99.5%, 99.9%, or 100% sequence identity to all or a contiguous portion of a target site sequence described herein above. In some embodiments, the target site is the sequence set forth in any one of SEQ ID NOS: 175, 138, 192, 152, 118, 125, 185, 63, 116, 124, 35, 82. In some embodiments, the reduction in gene expression or the change in the level of transcripts in a cell is greater than 90% compared to the level of gene in a control cell.

In any of the embodiments herein, the target site, or each of the target sites, comprises the sequence set forth in any one of SEQ ID NOS: 5, 10, 12, 18, 22, 26, 29, 38, 56, 61, 62, 63, 68, 72, 79, 80, 82, 84, 98, 99, 116, 118, 121, 124, 125, 135, 138, 143, 150, 152, 158, 164, 175, 176, 182, 185, 189, 190, 192, a contiguous portion thereof of at least 14 nucleotides (nt), or a complementary sequence of any of the foregoing. In some embodiments, the target site is a contiguous portion of any one of SEQ ID NOS: 5, 10, 12, 18, 22, 26, 29, 38, 56, 61, 62, 63, 68, 72, 75, 79, 80, 82, 84, 98, 99, 116, 118, 121, 124, 125, 135, 138, 143, 150, 152, 158, 164, 175, 176, 182, 185, 189, 190, 192, that is 15, 16, 17, 18 or 19 nucleotides in length, or a complementary sequence of any of the foregoing. In some embodiments, the target site is a sequence having at or at least 80%, 85%, 90%, 91%, 92%, 93%, 94%, 95%, 96%, 97%, 98%, 99%, 99.5%, 99.9%, or 100% sequence identity to all or a contiguous portion of a target site sequence described herein above. In some embodiments, the target site is the sequence set forth in any one of SEQ ID NOS: 5, 10, 12, 18, 22, 26, 29, 38, 56, 61, 62, 63, 68, 72, 75, 79, 80, 82, 84, 98, 99, 116, 118, 121, 124, 125, 135, 138, 143, 150, 152, 158, 164, 175, 176, 182, 185, 189, 190, or 192. In some embodiments, the reduction in gene expression or the change in the level of transcripts in a cell is greater than 80% compared to the level of gene in a control cell.

In any of the embodiments herein, the target site, or each of the target sites, comprises the sequence set forth in any one of SEQ ID NOS: 5, 6, 12, 18, 22, 26, 29, 38, 42, 43, 51, 56, 61, 63, 68, 72, 75, 79, 82, 84, 88, 89, 98, 99, 113, 116, 121, 124, 125, 118, 130, 133, 135, 138, 143, 150, 152, 155, 158, 164, 165, 175, 176, 182, 185, 189, 190, 192, a contiguous portion thereof of at least 14 nucleotides (nt), or a complementary sequence of any of the foregoing. In some embodiments, the target site is a contiguous portion of any one of SEQ ID NOS: 5, 6, 12, 18, 22, 26, 29, 38, 42, 43, 51, 56, 61, 63, 68, 72, 75, 79, 82, 84, 88, 89, 98, 99, 113, 116, 121, 124, 125, 118, 130, 133, 135, 138, 143, 150, 152, 155, 158, 164, 165, 175, 176, 182, 185, 189, 190, 192 that is 15, 16, 17, 18 or 19 nucleotides in length, or a complementary sequence of any of the foregoing. In some embodiments, the target site is a sequence having at or at least 80%, 85%, 90%, 91%, 92%, 93%, 94%, 95%, 96%, 97%, 98%, 99%, 99.5%, 99.9%, or 100% sequence identity to all or a contiguous portion of a target site sequence described herein above. In some embodiments, the target site is the sequence set forth in any one of SEQ ID NOS: 5, 6, 12, 18, 22, 26, 29, 38, 42, 43, 51, 56, 61, 63, 68, 72, 75, 79, 82, 84, 88, 89, 98, 99, 113, 116, 121, 124, 125, 118, 130, 133, 135, 138, 143, 150, 152, 155, 158, 164, 165, 175, 176, 182, 185, 189, 190, or 192. In some embodiments, the reduction in gene expression or the change in the level of transcripts in a cell is greater than 75% compared to the level of gene in a control cell.

In any of the embodiments herein, the target site, or each of the target sites, comprises the sequence set forth in any one of SEQ ID NOs: 22, 63, 75, 99, 116, 124, 138, 143, 150, 152, 175, 176, 192, a contiguous portion thereof of at least 14 nucleotides (nt), or a complementary sequence of any of the foregoing. In some embodiments, the target site comprises the sequence SEQ ID NO: 22, 63, 75, 99, 116, 124, 138, 143, 150, 152, 175, 176, 192, that is 15, 16, 17, 18 or 19 nucleotides in length, or a complementary sequence of any of the foregoing. In some embodiments, the target site is a sequence having at or at least 80%, 85%, 90%, 91%, 92%, 93%, 94%, 95%, 96%, 97%, 98%, 99%, 99.5%, 99.9%, or 100% sequence identity to all or a contiguous portion of a target site sequence described herein above. In some embodiments, the target site is the sequence set forth in any one of SEQ ID NOS: 22, 63, 75, 99, 116, 124, 138, 143, 150, 152, 175, 176, or 192.

In any of the embodiments herein, the target site, or each of the target sites, comprises the sequence set forth in any one of SEQ ID NOS: 12, 18, 20, 22, 26, 27, 46, 50, 63, 66, 73, 79, 185, 192, a contiguous portion thereof of at least 14 nucleotides (nt), or a complementary sequence of any of the foregoing. In some embodiments, the target site is a contiguous portion of any one of SEQ ID NOS: 12, 18, 20, 22, 26, 27, 46, 50, 63, 66, 73, 79, 185, 192, that is 15, 16, 17, 18 or 19 nucleotides in length, or a complementary sequence of any of the foregoing. In some embodiments, the target site is a sequence having at or at least 80%, 85%, 90%, 91%, 92%, 93%, 94%, 95%, 96%, 97%, 98%, 99%, 99.5%, 99.9%, or 100% sequence identity to all or a contiguous portion of a target site sequence described herein above. In some embodiments, the target site is the sequence set forth in any one of SEQ ID NOS: 12, 18, 20, 22, 26, 27, 46, 50, 63, 66, 73, 79, 185, or 192.

In some embodiments, the target site, or each of the target sites, comprises the nucleotide sequence set forth in any one of SEQ ID NOS:1028-1055, a contiguous portion thereof of at least 12 nt, or a complementary sequence of any of the foregoing. In some embodiments, the target site is a contiguous portion of any one of SEQ ID NOS: 1028-1055 that is 13, 14, 16, 16, 17 or 18 nucleotides in length, or a complementary sequence of any of the foregoing. In some embodiments, the target site is the sequence set forth in any one of SEQ ID NOS: 1028-1055.

In some embodiments, the target site, or each of the target sites, comprises the sequence set forth in SEQ ID NO: 22, a contiguous portion thereof of at least 14 nucleotides (nt), or a complementary sequence of the foregoing. In any of the embodiments herein, the target site, or each of the target sites, comprises a contiguous portion of the sequence set forth in SEQ ID NO: 22 that is 14-19 nucleotides (nt) in length, or a complementary sequence of the foregoing. In some embodiments, the target site is the sequence set forth in SEQ ID NO: 22. In some embodiments, the target site may be targeted by a DNA-targeting system provided herein. In some embodiments, the DNA-binding domain is a dCas9 that is a dSpCas9 and is used in combination with a complementary gRNA for targeting to the target site. In some embodiments, the gRNA has a spacer sequence set forth in SEQ ID NO:217 or a contiguous portion thereof that is complementary to the target site. In some embodiments, the gRNA further includes a scaffold sequence for dSpCas9 set forth in SEQ ID NO:587. In some embodiments, the DNA-targeting system includes an dSpCas9 fusion protein with a effector domain described herein, and the gRNA set forth in SEQ ID NO:22 (e.g, HBVg_22).

In some embodiments, the target site, or each of the target sites, comprises the sequence set forth in SEQ ID NO: 63, a contiguous portion thereof of at least 14 nucleotides (nt), or a complementary sequence of the foregoing. In any of the embodiments herein, the target site, or each of the target sites, comprises a contiguous portion of the sequence set forth in SEQ ID NO: 63 that is 14-20 nucleotides (nt) in length, or a complementary sequence of the foregoing. In some embodiments, the target site is the sequence set forth in SEQ ID NOS: 63. In some embodiments, the target site may be targeted by a DNA-targeting system provided herein. In some embodiments, the DNA-binding domain is a dCas9 that is a dSpCas9 and is used in combination with a complementary gRNA for targeting to the target site. In some embodiments, the gRNA has a spacer sequence set forth in SEQ ID NO:217 or a contiguous portion thereof that is complementary to the target site. In some embodiments, the gRNA further includes a scaffold sequence for SpCas9 set forth in SEQ DI NO:587. In some embodiments, the DNA-targeting system includes an dSpCas9 fusion protein with a effector domain described herein, and the gRNA set forth in SEQ ID NO:63 (e.g, HBVg_63).

In any of the embodiments herein, the target site, or each of the target sites, comprises the sequence set forth in SEQ ID NO: 1045, a contiguous portion thereof of at least 12 nucleotides (nt), or a complementary sequence of the foregoing. In any of the embodiments herein, the target site, or each of the target sites, comprises a contiguous portion of the sequence set forth in SEQ ID NO: 1045 that is 12-18 nucleotides (nt) in length, or a complementary sequence of the foregoing. In some embodiments, the target site is the sequence set forth in SEQ ID NOS: 1045. In some embodiments, the DNA-binding domain is a eZFP for targeting to the target site. In some embodiments, the ZFP includes recognition motifs set forth in SEQ ID NOS: 822, 823, 824, 825, 826 and 827. In some embodiments, the eZFP has the sequence set forth in SEQ ID NO: 709. In some embodiments, the eZFP is the eZFP designatied eZFP_18.

In any of the embodiments herein, the target site, or each of the target sites, comprises the sequence set forth in SEQ ID NO: 1046, a contiguous portion thereof of at least 12 nucleotides (nt), or a complementary sequence of the foregoing. In any of the embodiments herein, the target site, or each of the target sites, comprises a contiguous portion of the sequence set forth in SEQ ID NO: 1046 that is 12-18 nucleotides (nt) in length, or a complementary sequence of the foregoing. In some embodiments, the target site is the sequence set forth in SEQ ID NOS: 1046. In some embodiments, the DNA-binding domain is an eZFP for targeting to the target site. In some embodiments, the ZFP includes recognition motifs set forth in SEQ ID NOS: 828, 829, 830, 831, 832 and 833. In some embodiments, the eZFP has the sequence set forth in SEQ ID NO: 710. In some embodiments, the eZFP is the eZFP designatied eZFP_19.

In any of the embodiments herein, the target site, or each of the target sites, comprises the sequence set forth in SEQ ID NO: 1052, a contiguous portion thereof of at least 12 nucleotides (nt), or a complementary sequence of the foregoing. In any of the embodiments herein, the target site, or each of the target sites, comprises a contiguous portion of the sequence set forth in SEQ ID NO: 1052 that is 12-18 nucleotides (nt) in length, or a complementary sequence of the foregoing. In some embodiments, the target site is the sequence set forth in SEQ ID NOS: 1052. In some embodiments, the DNA-binding domain is a eZFP for targeting to the target site. In some embodiments, the ZFP includes recognition motifs set forth in SEQ ID NOS: 864, 865, 866, 867, 868 and 869. In some embodiments, the eZFP has the sequence set forth in SEQ ID NO: 716. In some embodiments, the eZFP is the eZFP designatied eZFP_25.

In some embodiments, the target site is present in a covalently closed circular DNA (cccDNA), relaxed circular DNA (rcDNA) and/or is integrated in the human genomic DNA. In some embodiments, targeting the target site results in silencing of HBV replication (e.g., reduced HBV replication) and/or HBV transcription.

In some embodiments, provided herein are multiplexed epigenetic-modifying DNA-targeting systems that target a combination of at least two target genes or regulatory DNA elements thereof described herein. In some embodiments, the multiplexed epigenetic-modifying DNA-targeting systems target two, three, four, five, six or more target genes or regulatory DNA elements thereof described herein.

In some embodiments, in provided multiplexed epigenetic-modifying DNA-targeting systems the target sites are each in a different HBV gene. In some embodiments, the target sites are each in the same HBV gene.

In some embodiments, provided herein are multiplexed epigenetic-modifying DNA-targeting systems that target any combination of genes and/or regulatory elements thereof described herein.

In some embodiments, provided herein are multiplexed epigenetic-modifying DNA-targeting systems that target a first gene or a regulatory element thereof and a second gene or a regulatory element thereof. In some embodiments, the first gene or regulatory element thereof is selected from the list consisting of the polymerase gene, S-family gene, X-gene, core family gene, pre-S1 promoter, pre-S2 promoter, X promoter, basal core promoter, Enh1 enhancer, Enh2 enhancer, a transcript processing control region, and any coding region within the HBV genome, the second gene or regulatory element thereof is selected from the list consisting of the polymerase gene, S-family gene, X-gene, core family gene, pre-S1 promoter, pre-S2 promoter, X promoter, basal core promoter, Enh1 enhancer, Enh2 enhancer, a transcript processing control region, and any coding region within the HBV genome, and the first gene or a regulatory element thereof is different from the second gene or a regulatory element thereof. The first and second target site can be any as described above.

In some embodiments, provided herein are multiplexed epigenetic-modifying DNA-targeting systems that target a first regulatory element and a second regulatory element. In some embodiments, the first regulatory element and second regulatory element thereof are selected from a combination listed in Table 1.

TABLE 1

Combinations of a first regulatory element and a second regulatory element targeted by a multiplexed epigenetic-modifying DNA-targeting system provided herein

| First regulatory element | Second regulatory element |
| --- | --- |
| L-HBs promoter | M-HBs promoter |
| L-HBs promoter | S-HBs promoter |
| L-HBs promoter | X-promoter/Enh1 promoter |
| L-HBs promoter | Basal core promoter/Enh2 enhancer |
| M-HBs promoter | S-HBs promoter |
| M-HBs promoter | X-promoter/Enh1 promoter |
| M-HBs promoter | Basal core promoter/Enh2 enhancer |
| S-HBs promoter | X-promoter/Enh1 promoter |
| S-HBs promoter | Basal core promoter/Enh2 enhancer |
| X-promoter/Enh1 promoter | Basal core promoter/Enh2 enhancer |

In some embodiments, provided herein are multiplexed epigenetic-modifying DNA-targeting systems that target a first gene or a regulatory element thereof, a second gene or a regulatory element thereof and a third gene or a regulatory element thereof. In some embodiments, the first gene or regulatory element thereof is selected from the list consisting of the polymerase gene, S-family gene, X-gene, core family gene, pre-S1 promoter, pre-S2 promoter, X promoter, basal core promoter, Enh1 enhancer, Enh2 enhancer, a transcript processing control region, and any coding region within the HBV genome, the second gene or regulatory element thereof is selected from the list consisting of the polymerase gene, S-family gene, X-gene, core family gene, pre-S1 promoter, pre-S2 promoter, X promoter, basal core promoter, Enh1 enhancer, Enh2 enhancer, a transcript processing control region, and any coding region within the HBV genome, the third gene or regulatory element thereof thereof is selected from the list consisting of the polymerase gene, S-family gene, X-gene, core family gene, pre-S1 promoter, pre-S2 promoter, X promoter, basal core promoter, Enh1 enhancer, Enh2 enhancer, a transcript processing control region, and the first gene or a regulatory element thereof, the second gene or a regulatory element thereof and the third gene or a regulatory element thereof are different from each other. The first, second and third target site can be any as described above.

In some embodiments, provided herein are multiplexed epigenetic-modifying DNA-targeting systems that target a first regulatory element, a second regulatory element, and a third regulatory element thereof. In some embodiments, the first regulatory element is selected from the list consisting of of L-HBs promoter, M-HBs promoter, S-HBs promoter, X-promoter, Basal core promoter, Enh1 enhancer, and Enh2 enhancer, the second regulatory element thereof is selected from the list consisting of of L-HBs promoter, M-HBs promoter, S-HBs promoter, X-promoter, Basal core promoter, Enh1 enhancer, and Enh2 enhancer, the third regulatory element thereof is selected from the list consisting of L-HBs promoter, M-HBs promoter, S-HBs promoter, X-promoter, Basal core promoter, Enh1 enhancer, and Enh2 enhancer, and the first, second, and third regulatory elements are different. In some embodiments, the first regulatory element is Enh1 enhancer, the second regulatory element is selected from the list consisting of L-HBs promoter, M-HBs promoter, S-HBs promoter, X-promoter, Basal core promoter, and Enh2 enhancer, the third regulatory element is selected from the list consisting of L-HBs promoter, M-HBs promoter, S-HBs promoter, X-promoter, Basal core promoter, and Enh2 enhancer, and the second regulatory element and third regulatory element thereof are different. In some embodiments, the first regulatory element is Enh1 enhancer, the second regulatory element is L-HBs, and the third regulatory element is selected from the list consisting of M-HBs promoter, S-HBs promoter, X-promoter, Basal core promoter, and Enh2 enhancer.

In some embodiments, the first regulatory element, second regulatory element, and third regulatory element are selected from a combination listed in Table 2.

TABLE 2

Combinations of a first regulatory element, second regulatory element, and third regulatory element targeted by a multiplexed epigenetic-modifying DNA-targeting system provided herein.

| First regulatory element | Second regulatory element | Third regulatory element |
|---|---|---|
| L-HBs promoter | M-HBs promoter | S-HBs promoter |
| L-HBs promoter | M-HBs promoter | X-promoter/Enh1 promoter |
| L-HBs promoter | M-HBs promoter | Basal core promoter/Enh2 enhancer |

TABLE 2-continued

Combinations of a first regulatory element, second regulatory element, and third regulatory element targeted by a multiplexed epigenetic-modifying DNA-targeting system provided herein.

| First regulatory element | Second regulatory element | Third regulatory element |
|---|---|---|
| L-HBs promoter | S-HBs promoter | X-promoter/Enh1 promoter |
| L-HBs promoter | S-HBs promoter | Basal core promoter/Enh2 enhancer |
| L-HBs promoter | X-promoter/Enh1 promoter | Basal core promoter/Enh2 enhancer |
| M-HBs promoter | S-HBs promoter | X-promoter/Enh1 promoter |
| M-HBs promoter | S-HBs promoter | Basal core promoter/Enh2 enhancer |
| M-HBs promoter | X-promoter/Enh1 promoter | Basal core promoter/Enh2 enhancer |
| S-HBs promoter | X-promoter/Enh1 promoter | Basal core promoter/Enh2 enhancer |

In some embodiments, provided herein are multiplexed epigenetic-modifying DNA-targeting systems that target a first gene or a regulatory element thereof, a second gene or a regulatory element thereof, a third gene or a regulatory element thereof and a fourth gene or regulatory element thereof. In some embodiments, the first gene or regulatory element thereof is selected from the list consisting of the polymerase gene, S-family gene, X-gene, core family gene, pre-S1 promoter, pre-S2 promoter, X promoter, basal core promoter, Enh1 enhancer, Enh2 enhancer, a transcript processing control region, and any coding region within the HBV genome, the second gene or regulatory element thereof is selected from the list consisting of the polymerase gene, S-family gene, X-gene, core family gene, pre-S1 promoter, pre-S2 promoter, X promoter, basal core promoter, Enh1 enhancer, Enh2 enhancer, a transcript processing control region, and any coding region within the HBV genome, the third gene or regulatory element thereof thereof is selected from the list consisting of the polymerase gene, S-family gene, X-gene, core family gene, pre-S1 promoter, pre-S2 promoter, X promoter, basal core promoter, Enh1 enhancer, Enh2 enhancer, a transcript processing control region, the fourth gene or regulatory element thereof thereof is selected from the list consisting of the polymerase gene, S-family gene, X-gene, core family gene, pre-S1 promoter, pre-S2 promoter, X promoter, basal core promoter, Enh1 enhancer, Enh2 enhancer, a transcript processing control regionand the first gene or a regulatory element thereof, the second gene or a regulatory element thereof, the third gene or a regulatory element thereof, and the fourth gene or a regulatory element thereof are different from each other. The first, second, third and fourth target site can be any as described above.

In some embodiments, provided herein are multiplexed epigenetic-modifying DNA-targeting systems that target the same gene or a regulatory element thereof. For example, two or more multiplexed epigenetic-modifying DNA-targeting systems target the same or common gene or regulatory element thereof. In some embodiments, the gene or regulatory element thereof is selected from the list consisting of the polymerase gene, S-family gene, X-gene, core family gene, pre-S1 promoter, pre-S2 promoter, X promoter, basal core promoter, Enh1 enhancer, Enh2 enhancer, a transcript processing control region, and any coding region within the HBV genome, the second gene or regulatory element thereof is selected from the list consisting of the polymerase gene, S-family gene, X-gene, core family gene, pre-S1 promoter, pre-S2 promoter, X promoter, basal core promoter, Enh1 enhancer, Enh2 enhancer, a transcript processing control region, and any coding region within the HBV genome. In some embodiments, at least 2, at least 3, at least 4, at least 5, at least 6, at least 7, at least 8, at least 9, at least 10, at least 20, at least 30, multiplexed epigenetic-modifying DNA-targeting systems target the same gene or a regulatory element thereof.

In some embodiments, the target site for multiplexed editing (e.g., by multiplexed epigenetic-modifying DNA-targeting systems described herein) is the sequence set forth in any one of SEQ ID NOS: 12, 18, 20, 22, 26, 27, 46, 50, 63, 66, 73, 79, 185, 192. In some embodiments, the target site for multiplexed editing (e.g., by multiplexed epigenetic-modifying DNA-targeting systems described herein) is the sequence set forth in SEQ ID NO: 22. The target site can be any as described above. B. CRISPR-Based DNA-Targeting Systems Provided herein are epigenetic DNA-targeting systems based on CRISPR/Cas systems, i.e., CRISPR/Cas-based DNA-targeting systems that are able to bind to a target site in a target gene or regulatory element thereof. In some embodiments, the provided epigenetic DNA-targeting systems are multiplexed epigenetic-DNA-targeting systems based on CRISPR/Cas systems, i.e., CRISPR/Cas-based DNA-targeting systems that are able to target sites in a combination of target genes or regulatory element thereof.

In some embodiments, the CRISPR/Cas DNA-binding domain is nuclease inactive, such as includes a dCas (e.g. dCas9) so that the system binds to the target site in a target gene or regulatory element thereof without mediating nucleic acid cleavage at the target site. In some embodiments, the DNA-targeting system does not introduce a genetic disruption or a DNA break. The CRISPR/Cas-based DNA-targeting systems may be used to modulate expression of a target gene in a cell, such as a hepatocyte. In some embodiments, the target gene or regulatory element thereof may include any as described herein, including any described above in Section I.A. In some embodiments, the target site of the target gene or regulatory element thereof may include any as described herein, including any described above in Section I.A. In some embodiments, the CRISPR/Cas-based DNA-targeting system can include any known Cas enzyme, and generally a nuclease-inactive or dCas. In some embodiments, the CRISPR/Cas-based DNA-targeting system includes a fusion protein of a nuclease-inactive Cas protein or a variant thereof and an effector domain that reduces transcription of a gene (e.g., a transcriptional repressor), and at least one gRNA.

The CRISPR system (also known as CRISPR/Cas system, or CRISPR-Cas system) refers to a conserved microbial nuclease system, found in the genomes of bacteria and archaea, that provides a form of acquired immunity against invading phages and plasmids. Clustered Regularly Interspaced Short Palindromic Repeats (CRISPR), refers to loci containing multiple repeating DNA elements that are separated by non-repeating DNA sequences called spacers. Spacers are short sequences of foreign DNA that are incorporated into the genome between CRISPR repeats, serving as a 'memory' of past exposures. Spacers encode the DNA-targeting portion of RNA molecules that confer specificity for nucleic acid cleavage by the CRISPR system. CRISPR loci contain or are adjacent to one or more CRISPR-associated (Cas) genes, which can act as RNA-guided nucleases for mediating the cleavage, as well as non-protein coding DNA elements that encode RNA molecules capable of programming the specificity of the CRISPR-mediated nucleic acid cleavage.

In Type II CRISPR/Cas systems with the Cas protein Cas9, two RNA molecules and the Cas9 protein form a ribonucleoprotein (RNP) complex to direct Cas9 nuclease activity. The CRISPR RNA (crRNA) contains a spacer sequence that is complementary to a target nucleic acid sequence (target site), and that encodes the sequence specificity of the complex. The trans-activating crRNA (tracrRNA) base-pairs to a portion of the crRNA and forms a structure that complexes with the Cas9 protein, forming a Cas/RNA RNP complex.

Naturally occurring CRISPR/Cas systems, such as those with Cas9, have been engineered to allow efficient programming of Cas/RNA RNPs to target desired sequences in cells of interest, both for gene-editing and modulation of gene expression. The tracrRNA and crRNA have been engineered to form a single chimeric guide RNA molecule, commonly referred to as a guide RNA (gRNA), for example as described in WO 2013/176772 A1, WO 2014/093661 A2, WO 2014/093655 A2, Jinek, M. et al. Science 337(6096): 816-21 (2012), or Cong, L. et al. Science 339(6121):819-23 (2013). The spacer sequence of the gRNA can be chosen by a user to target the Cas/gRNA RNP complex to a desired locus, e.g. a desired target site in the target gene and/or regulatory element thereof.

Cas proteins have also been engineered to allow targeting of Cas/gRNA RNPs without inducing cleavage at the target site. Mutations in Cas proteins can reduce or abolish nuclease activity of the Cas protein, rendering the Cas protein catalytically inactive. Cas proteins with reduced or abolished nuclease activity are referred to as deactivated Cas (dCas), or nuclease-inactive Cas (iCas) proteins, as referred to interchangeably herein. Exemplary deactivated Cas9 (dCas9) derived from *S. pyogenes* contains silencing mutations of the RuvC and HNH nuclease domains (D10A and H840A), for example as described in WO 2013/176772 A1, WO 2014/093661 A2, Jinek, M. et al. Science 337(6096): 816-21 (2012), and Qi, L. et al. Cell 152(5):1173-83 (2013). Exemplary dCas variants derived from the Cas12 system (i.e. Cpf1) are described, for example in WO 2017/189308 A1 and Zetsche, B. et al. Cell 163(3):759-71 (2015). Conserved domains that mediate nucleic acid cleavage, such as RuvC and HNH endonuclease domains, are readily identifiable in Cas orthologues, and can be mutated to produce inactive variants, for example as described in Zetsche, B. et al. Cell 163(3):759-71 (2015).

dCas-fusion proteins with transcriptional and/or epigenetic regulators have been used as a versatile platform for ectopically regulating gene expression in target cells. These include fusion of a Cas with an effector domain, such as a transcriptional activator or transcriptional repressor. For example, fusing dCas9 with a transcriptional activator such as VP64 (a polypeptide composed of four tandem copies of VP16, a 16 amino acid transactivation domain of the Herpes simplex virus) can result in robust induction of gene expression. Alternatively, fusing dCas9 with a transcriptional repressor such as KRAB (Kruppel associated box) can result in robust repression of gene expression. A variety of dCas-fusion proteins with transcriptional and epigenetic regulators can be engineered for regulation of gene expression, for example as described in WO 2014/197748, WO 2016/130600, WO 2017/180915, WO 2021/226555, WO 2013/176772, WO 2014/152432, WO 2014/093661 WO 2021/247570, Adli, M. Nat. Commun. 9, 1911 (2018), Perez-Pinera, P. et al. Nat. Methods 10, 973-976 (2013), Mali, P. et al. Nat. Biotechnol. 31, 833-838 (2013), Maeder, M. L. et al. Nat. Methods 10, 977-979 (2013), Gilbert, L. A. et al. Cell 154(2):442-451 (2013), and Nunez, J. K. et al. Cell 184(9):2503-2519 (2021).

In some aspects, provided is a DNA-targeting system comprising a fusion protein comprising a DNA-binding domain comprising a nuclease-inactive Cas protein or variant thereof, and an effector domain for reducing transcription or inducing transcriptional repression (i.e. a transcriptional repressor) when targeted to the target gene or regulatory element thereof in the cell (e.g. hepatocyte). In such embodiments, the DNA-targeting system also includes one or more gRNAs, provided in combination or as a complex with the dCas protein or variant thereof, for targeting of the DNA-targeting system to the target site of the target gene or regulatory element thereof. In some embodiments, the fusion protein is guided to a specific target site sequence of the target geneor regulatory element thereof by the guide RNA, wherein the effector domain mediates targeted epigenetic modification to reduce or repress transcription of the target gene. In some embodiments, a combination of gRNAs guides the fusion protein to a combination of target site sequences in a combination of genes or regulatory elements thereof, wherein the effector domain mediates targeted epigenetic modification to reduce or repress transcription of the combination of target genes. Any of a variety of effector domains that reduce or repress transcription can be used as described further below.

1. CRISPR-Based DNA-Biding Domains

In some aspects, the DNA-binding domain comprises a CRISPR-associated (Cas) protein or variant thereof, or is derived from a Cas protein or variant thereof, and is nuclease-inactive (i.e. is a dCas protein).

In some embodiments, the Cas protein is derived from a Class 1 CRISPR system (i.e. multiple Cas protein system), such as a Type I, Type III, or Type IV CRISPR system. In some embodiments, the Cas protein is derived from a Class 2 CRISPR system (i.e. single Cas protein system), such as a Type II, Type V, or Type VI CRISPR system. In some embodiments, the Cas protein is from a Type V CRISPR system. In some embodiments, the Cas protein is derived from a Cas12 protein (i.e. Cpf1) or variant thereof, for example as described in WO 2017/189308 A1 and Zetsche, B. et al. Cell. 163(3):759-71 (2015). In some embodiments, the Cas protein is derived from a Type II CRISPR system. In some embodiments, the Cas protein is derived from a Cas9 protein or variant thereof, for example as described in WO 2013/176772 A1, WO 2014/152432 A2, WO 2014/093661 A2, WO 2014/093655 A2, Jinek, M. et al. Science 337(6096):816-21 (2012), Mali, P. et al. Science 339(6121): 823-6 (2013), Cong, L. et al. Science 339(6121):819-23 (2013), Perez-Pinera, P. et al. Nat. Methods 10, 973-976 (2013), or Mali, P. et al. Nat. Biotechnol. 31, 833-838 (2013). Various CRISPR/Cas systems and associated Cas proteins for use in gene editing and regulation have been described, for example in Moon, S. B. et al. Exp. Mol. Med. 51, 1-11 (2019), Zhang, F. Q. Rev. Biophys. 52, E6 (2019), and Makarova K.S. et al. Methods Mol. Biol. 1311:47-75 (2015).

In some embodiments, the dCas9 protein can comprise a sequence derived from a naturally occurring Cas9 molecule, or variant thereof. In some embodiments, the dCas9 protein can comprise a sequence derived from a naturally occurring Cas9 molecule of *S. pyogenes, S. thermophilus, S. aureus, C. jejuni, N. meningitidis, F. novicida, S. canis, S. auricularis*, or variant thereof. In some embodiments, the dCas9 protein comprises a sequence derived from a naturally occurring Cas9 molecule of *S. aureus*. In some embodiments, the dCas9 protein comprises a sequence derived from a naturally occurring Cas9 molecule of *S. pyogenes*.

Non-limiting examples of Cas9 orthologs from other bacterial strains include but are not limited to: Cas proteins identified in *Acaryochloris marina* MBIC11017; *Acetohalobium arabaticum* DSM 5501; *Acidithiobacillus caldus; Acidithiobacillus ferrooxidans* ATCC 23270; *Alicyclobacillus acidocaldarius* LAA1; *Alicyclobacillus acidocaldarius* subsp. *acidocaldarius* DSM 446; *Allochromatium vinosum* DSM 180; *Ammonifex degensii* KC4; *Anabaena variabilis* ATCC 29413; *Arthrospira maxima* CS-328; *Arthrospira platensis* str. Paraca; *Arthrospira* sp. PCC 8005; *Bacillus pseudomycoides* DSM 12442; *Bacillus selenitireducens* MLS10; *Burkholderiales bacterium* 1_1_47; *Caldicellulosiruptor becscii* DSM 6725; *Candidatus Desulforudis audaxviator* MP104C; *Caldicellulosiruptor hydrothermalis* 108; *Clostridium* phage c-st; *Clostridium botulinum* A3 str. Loch Maree; *Clostridium botulinum* Ba4 str. 657; *Clostridium difficile* QCD-63q42; *Crocosphaera watsonii* WH 8501; *Cyanothece* sp. ATCC 51142; *Cyanothece* sp. CCY0110; *Cyanothece* sp. PCC 7424; *Cyanothece* sp. PCC 7822; *Exiguobacterium sibiricum* 255-15; *Finegoldia magna* ATCC 29328; *Ktedonobacter racemifer* DSM 44963; *Lactobacillus delbrueckii* subsp. *bulgaricus* PB2003/044-T3-4; *Lactobacillus salivarius* ATCC 11741; *Listeria innocua; Lyngbya* sp. PCC 8106; *Marinobacter* sp. ELB17; *Methanohalobium evestigatum* Z-7303; *Microcystis* phage Ma-LMM01; *Microcystis aeruginosa* NIES-843; *Microscilla marina* ATCC 23134; *Microcoleus chthonoplastes* PCC 7420; *Neisseria meningitidis; Nitrosococcus halophilus* Nc4; *Nocardiopsis dassonvillei* subsp. *dassonvillei* DSM 43111; *Nodularia spumigena* CCY9414; *Nostoc* sp. PCC 7120; *Oscillatoria* sp. PCC 6506; *Pelotomaculum_thermopropionicum* SI; *Petrotoga mobilis* SJ95; *Polaromonas naphthalenivorans* CJ2; *Polaromonas* sp. JS666; *Pseudoalteromonas haloplanktis* TAC125; *Streptomyces pristinaespiralis* ATCC 25486; *Streptomyces pristinaespiralis* ATCC 25486; *Streptococcus thermophilus; Streptomyces viridochromogenes* DSM 40736; *Streptosporangium roseum* DSM 43021; *Synechococcus* sp. PCC 7335; and *Thermosipho africanus* TCF52B (Chylinski et al., RNA Biol., 2013; 10(5): 726-737).

In some aspects, the Cas protein is a variant that lacks nuclease activity (i.e. is a dCas protein). In some embodiments, the Cas protein is mutated so that nuclease activity is reduced or eliminated. Such Cas proteins are referred to as deactivated Cas or dead Cas (dCas) or nuclease-inactive Cas (iCas) proteins, as referred to interchangeably herein. In some embodiments, the variant Cas protein is a variant Cas9 protein that lacks nuclease activity or that is a deactivated Cas9 (dCas9, or iCas9) protein.

In some embodiments, the Cas9 protein or a variant thereof is derived from a *Staphylococcus aureus* Cas9 (SaCas9) protein or a variant thereof. In some embodiments, the variant Cas9 is a *Staphylococcus aureus* dCas9 protein (dSaCas9) that comprises at least one amino acid mutation selected from D10A and N580A, with reference to numbering of positions of SEQ ID NO: 596. In some embodiments, the variant Cas9 protein comprises the sequence set forth in SEQ ID NO: 597, or an amino acid sequence that has at least 90%, 91%, 92%, 93%, 94%, 95%, 96%, 97%, 98%, or 99% sequence identity thereto.

In some embodiments, the Cas9 protein or variant thereof is derived from a *Streptococcus pyogenes* Cas9 (SpCas9) protein or a variant thereof. In some embodiments, the variant Cas9 is a *Streptococcus pyogenes* dCas9 (dSpCas9) protein that comprises at least one amino acid mutation selected from D10A and H840A, with reference to numbering of positions of SEQ ID NO:598. In some embodiments, the variant Cas9 protein comprises the sequence set forth in SEQ ID NO:599, or an amino acid sequence that has at least 90%, 91%, 92%, 93%, 94%, 95%, 96%, 97%, 98%, or 99% sequence identity thereto.

2. Guide RNAs

In some embodiments, the Cas protein (e.g. dCas9) is provided in combination or as a complex with one or more guide RNA (gRNA). In some aspects, the gRNA is a nucleic acid that promotes the specific targeting or homing of the gRNA/Cas RNP complex to the target site of the target gene and/or regulatory element thereof, such as any described above. In some embodiments, a target site of a gRNA may be referred to as a protospacer.

Provided herein are gRNAs, such as gRNAs that target or bind to a target site or DNA regulatory element thereof, such as any described above in Section I.A. In some embodiments, the gRNA is capable of complexing with the Cas protein or variant thereof. In some embodiments, the gRNA comprises a gRNA spacer sequence (i.e. a spacer sequence or a guide sequence) that is capable of hybridizing to the target site, or that is complementary to the target site, such as any target site described in Section L.A or further below. In some embodiments, the gRNA comprises a scaffold sequence that complexes with or binds to the Cas protein.

In some embodiments, the gRNAs provided herein are chimeric gRNAs. In general, gRNAs can be unimolecular (i.e. consisting of a single RNA molecule), or modular (comprising more than one, and typically two, separate RNA molecules). Modular gRNAs can be engineered to be unimolecular, wherein sequences from the separate modular RNA molecules are comprised in a single gRNA molecule, sometimes referred to as a chimeric gRNA, synthetic gRNA, or single gRNA. In some embodiments, the chimeric gRNA is a fusion of two non-coding RNA sequences: a crRNA sequence and a tracrRNA sequence, for example as described in WO 2013/176772 A1, or Jinek, M. et al. Science 337(6096):816-21 (2012). In some embodiments, the chimeric gRNA mimics the naturally occurring crRNA:tracrRNA duplex involved in the Type II Effector system, wherein the naturally occurring crRNA:tracrRNA duplex acts as a guide for the Cas9 protein.

In some aspects, the spacer sequence of a gRNA is a polynucleotide sequence comprising at least a portion that has sufficient complementarity with the target site or DNA regulatory element thereof (e.g. any described in Section I.A) to hybridize with a target site in the target gene and/or regulatory element thereof and direct sequence-specific binding of a CRISPR complex to the sequence of the target site. Full complementarity is not necessarily required, provided there is sufficient complementarity to cause hybridization and promote formation of a CRISPR complex. In some embodiments, the gRNA comprises a spacer sequence that is complementary, e.g., at least 80%, 85%, 90%, 95%, 98%, 99%, or 100% (e.g., fully complementary), to the target site. The strand of the target nucleic acid comprising the target site sequence may be referred to as the "complementary strand" of the target nucleic acid.

In some embodiments, the gRNA spacer sequence is between about 14 nucleotides (nt) and about 26 nt, or between 16 nt and 22 nt in length. In some embodiments, the gRNA spacer sequence is 14 nt, 15 nt, 16 nt, 17 nt, 18 nt, 19 nt, 20 nt, 21 nt or 22 nt, 23 nt, 24 nt, 25 nt, or 26 nt in length. In some embodiments, the gRNA spacer sequence is 18 nt, 19 nt, 20 nt, 21 nt or 22 nt in length. In some embodiments, the gRNA spacer sequence is 19 nt in length.

A target site of a gRNA may be referred to as a protospacer. In some aspects, the spacer is designed to target a protospacer with a specific protospacer-adjacent motif (PAM), i.e. a sequence immediately adjacent to the protospacer that contributes to and/or is required for Cas binding specificity. Different CRISPR/Cas systems have different PAM requirements for targeting. For example, in some embodiments, S. pyogenes Cas9 uses the PAM 5'-NGG-3', where N is any nucleotide. S. aureus Cas9 uses the PAM 5'-NNGRRT-3', where N is any nucleotide, and R is G or A. N. meningitidis Cas9 uses the PAM 5'-NNNNGATT-3', where N is any nucleotide. C. jejuni Cas9 uses the PAM 5'-NNNNRYAC-3', where N is any nucleotide, R is G or A, and Y is C or T. S. thermophilus uses the PAM 5'-NNAGAAW-3', where N is any nucleotide and W is A or T. F. Novicida Cas9 uses the PAM 5'-NGG-3', where N is any nucleotide. T. denticola Cas9 uses the PAM 5'-NAAAAC-3', where N is any nucleotide. Cas12a (also known as Cpf1) from various species, uses the PAM 5'-TTTV-3'. Cas proteins may use or be engineered to use different PAMs from those listed above. For example, mutated SpCas9 proteins may use the PAMs 5'-NGG-3', 5'-NGAN-3', 5'-NGNG-3', 5'-NGAG-3', or 5'-NGCG-3'. In some embodiments, the protospacer of a gRNA for complexing with S. pyogenes Cas9 or variant thereof is set forth in SEQ ID NO: 588. In some embodiments, the protospacer of a gRNA for complexing with S. aureus Cas9 or variant thereof is NNGRRT.

A spacer sequence may be selected to reduce the degree of secondary structure within the spacer sequence. Secondary structure may be determined by any suitable polynucleotide folding algorithm.

In some embodiments, the gRNA (including the guide sequence) will comprise the base uracil (U), whereas DNA encoding the gRNA molecule will comprise the base thymine (T). While not wishing to be bound by theory, in some embodiments, it is believed that the complementarity of the guide sequence with the target sequence contributes to specificity of the interaction of the gRNA molecule/Cas molecule complex with a target nucleic acid. It is understood that in a guide sequence and target sequence pair, the uracil bases in the guide sequence will pair with the adenine bases in the target sequence.

In some embodiments, one, more than one, or all of the nucleotides of a gRNA can have a modification, e.g., to render the gRNA less susceptible to degradation and/or improve bio-compatibility. By way of non-limiting example, the backbone of the gRNA can be modified with a phosphorothioate, or other modification(s). In some cases, a nucleotide of the gRNA can comprise a 2' modification, e.g., a 2-acetylation, e.g., a 2' methylation, or other modification(s).

Methods for designing gRNAs and exemplary targeting domains can include those described in, e.g., International PCT Pub. Nos. WO 2014/197748 A2, WO 2016/130600 A2, WO 2017/180915 A2, WO 2021/226555 A2, WO 2013/176772 A1, WO 2014/152432 A2, WO 2014/093661 A2, WO 2014/093655 A2, WO 2015/089427 A1, WO 2016/049258 A2, WO 2016/123578 A1, WO 2021/076744 A1, WO 2014/191128 A1, WO 2015/161276 A2, WO 2017/193107 A2, and WO 2017/093969 A1.

In some embodiments, the gRNA provided herein targets a target site present in a covalently closed circular DNA (cccDNA), relaxed circular DNA (rcDNA). In some aspects, the target site may be any HBV genome sequence optimal for depositing DNA methylation that results in silencing of HBV RNA transcription.

In some embodiments, the target site is at or near a gene or a regulatory element thereof involved in controlling HBV replication and/or HBV transcription. In some aspects, the target site is at or near a promoter. In some aspects, the target site is near an enhancer region. In some aspects, the target site is at or near transcript processing control region. In some aspects, the target site may be any gene optimal for depositing DNA methylation for silencing HBV transcription.

In some embodiments, the gRNA targets a target site that comprises a sequence selected from any one of SEQ ID NOS: 1-34, as shown in Table 3, a contiguous portion thereof of at least 14 nucleotides, a complementary sequence of any of the foregoing, or a sequence having at or at least 80%, 85%, 90%, 91%, 92%, 93%, 94%, 95%, 96%, 97%, 98%, 99%, 99.5%, 99.9%, or 100% sequence identity to any of the foregoing.

In some embodiments, the gRNA targets a target site that comprises a sequence selected from any one of SEQ ID NOS: 35-100, as shown in Table 4, or a contiguous portion thereof of at least 14 nt, or a sequence having at or at least 80%, 85%, 90%, 91%, 92%, 93%, 94%, 95%, 96%, 97%, 98%, 99%, 99.5%, 99.9%, or 100% sequence identity to any of the foregoing.

In some embodiments, a gRNA targets a target site that comprises a sequence selected from any one of SEQ ID NOS:101-195, as shown in Table 5, a contiguous portion thereof of at least 14 nucleotides, a complementary sequence of any of the foregoing, or a sequence having at or at least 80%, 85%, 90%, 91%, 92%, 93%, 94%, 95%, 96%, 97%, 98%, 99%, 99.5%, 99.9%, or 100% sequence identity to any of the foregoing.

In some embodiments, the gRNA further comprises a scaffold sequence set forth in SEQ ID NO: 587. In some embodiments, the gRNA further comprises a scaffold sequence. In some embodiments, the scaffold sequence comprises the sequence set forth in SEQ ID NO: 587 (GUUUAAGAGCUAUGCUGGAAACAG-CAUAGCAAGUUUAAAUAAGGCUAGU-CCGUUAUCA ACUUGAAAAAGUGGCACCGAGUCG-GUGC), or a sequence having at or at least 80%, 85%, 90%, 91%, 92%, 93%, 94%, 95%, 96%, 97%, 98%, 99%, 99.5%, 99.9%, or 100% sequence identity to all or a portion thereof. In some embodiments, the scaffold sequence is set forth in SEQ ID NO: 587.

In some embodiments, the gRNA comprises the sequence selected from any one of SEQ ID NOS: 391-585, as shown in Table 6, or a sequence having at or at least 80%, 85%, 90%, 91%, 92%, 93%, 94%, 95%, 96%, 97%, 98%, 99%, 99.5%, 99.9%, or 100% sequence identity to any one of SEQ ID NO: 391-585. In some embodiments, the gRNA is set forth in any one of SEQ ID NOS: 391-585.

In some embodiments, the gRNA comprises the sequence selected from any one of SEQ ID NOS: 391-424, or a sequence having at or at least 80%, 85%, 90%, 91%, 92%, 93%, 94%, 95%, 96%, 97%, 98%, 99%, 99.5%, 99.9%, or 100% sequence identity to any of the foregoing.

In some embodiments, the gRNA comprises the sequence selected from any one of SEQ ID NOS: 425-490, or a sequence having at or at least 80%, 85%, 90%, 91%, 92%, 93%, 94%, 95%, 96%, 97%, 98%, 99%, 99.5%, 99.9%, or 100% sequence identity to any of the foregoing.

In some embodiments, the gRNA comprises the sequence selected from any one of SEQ ID NOS: 490-585, or a sequence having at or at least 80%, 85%, 90%, 91%, 92%, 93%, 94%, 95%, 96%, 97%, 98%, 99%, 99.5%, 99.9%, or 100% sequence identity to any of the foregoing.

In some embodiments, any of the provided gRNA sequences is complexed with or is provided in combination with a Cas9. In some embodiments, the Cas9 is a dCas9. In some embodiments, the dCas9 is a dSpCas9, such as a dSpCas9 set forth in SEQ ID NO: 599.

TABLE 3

Target site sequences and gRNA spacers with >90% HBV genomic conservation and no mismatches (HBV0)

| Target Site (proto-spacer) sequence | Target SEQ ID | Sequence names | Median HBV position | RNAspacer sequence | RNA spacer SEQ ID |
|---|---|---|---|---|---|
| CCCTATCTTA TCAACACTTC | 1 | HBVg_1 | 2310 | CCCUAUCUUA UCAACACUUC | 196 |
| GCAGAGGTGA AAAAGTTGCA | 2 | HBVg_2 | 1834 | GCAGAGGUGA AAAAGUUGCA | 197 |
| TGGACTTCTC TCAATTTTCT | 3 | HBVg_3 | 259 | UGGACUUCUC UCAAUUUUCU | 198 |
| ACCCCGCCTG TAACACGAGC | 4 | HBVg_4 | 209 | ACCCCGCCUG UAACACGAGC | 199 |
| CCCGCCTGTA ACACGAGCAG | 5 | HBVg_5 | 207 | CCCGCCUGUA ACACGAGCAG | 200 |
| CACCACGAGT CTAGACTCTG | 6 | HBVg_6 | 261 | CACCACGAGU CUAGACUCUG | 201 |
| GAGGTGAAGC GAAGTGCACA | 7 | HBVg_7 | 1597 | GAGGUGAAGC GAAGUGCACA | 202 |
| CCGGAAGTGT TGATAAGATA | 8 | HBVg_8 | 2333 | CCGGAAGUGU UGAUAAGAUA | 203 |
| AGAAGATGAG GCATAGCAGC | 9 | HBVg_9 | 434 | AGAAGAUGAG GCAUAGCAGC | 204 |
| TCCGCAGTAT GGATCGGCAG | 10 | HBVg_10 | 1277 | UCCGCAGUAU GGAUCGGCAG | 205 |
| GGACTTCTCT CAATTTTCTA | 11 | HBVg_11 | 260 | GGACUUCUCU CAAUUUUCUA | 206 |
| CCACCCAAGG CACAGCTTGG | 12 | HBVg_12 | 1891 | CCACCCAAGG CACAGCUUGG | 207 |
| AGAGAGGTGC GCCCCGTGGT | 13 | HBVg_13 | 1535 | AGAGAGGUGC GCCCCGUGGU | 208 |
| GATTGAGATC TTCTGCGACG | 14 | HBVg_14 | 2433 | GAUUGAGAUC UUCUGCGACG | 209 |
| CAAGCCTCCA AGCTGTGCCT | 15 | HBVg_15 | 1864 | CAAGCCUCCA AGCUGUGCCU | 210 |
| GGCGAGGGAG TTCTTCTTCT | 16 | HBVg_16 | 2388 | GGCGAGGGAG UUCUUCUUCU | 211 |
| TCCGGAAGTG TTGATAAGAT | 17 | HBVg_17 | 2334 | UCCGGAAGUG UUGAUAAGAU | 212 |
| AAGCCACCCA AGGCACAGCT | 18 | HBVg_18 | 1894 | AAGCCACCCA AGGCACAGCU | 213 |
| CCTCCAAGCT GTGCCTTGGG | 19 | HBVg_19 | 1868 | CCUCCAAGCU GUGCCUUGGG | 214 |
| GTAAAGAGAG GTGCGCCCCG | 20 | HBVg_20 | 1539 | GUAAAGAGAG GUGCGCCCCG | 215 |
| GGCAGATGAG AAGGCACAGA | 21 | HBVg_21 | 157 | GGCAGAUGAG AAGGCACAGA | 216 |

TABLE 3-continued

Target site sequences and gRNA spacers with >90% HBV genomic conservation and no mismatches (HBV0)

| Target Site (protospacer) sequence | Target SEQ ID | Sequence names | Median HBV position | RNAspacer sequence | RNA spacer SEQ ID |
|---|---|---|---|---|---|
| AGGAGTTCCGCAGTATGGAT | 22 | HBVg_22 | 1283 | AGGAGUUCCGCAGUAUGGAU | 217 |
| GCTGTGCCTTGGGTGGCTTT | 23 | HBVg_23 | 1875 | GCUGUGCCUUGGGUGGCUUU | 218 |
| ACCCCTGCTCGTGTTACAGG | 24 | HBVg_24 | 183 | ACCCCUGCUCGUGUUACAGG | 219 |
| CGGAAGTGTTGATAAGATAG | 25 | HBVg_25 | 2332 | CGGAAGUGUUGAUAAGAUAG | 220 |
| CCTGCTGGTGGCTCCAGTTC | 26 | HBVg_26 | 55 | CCUGCUGGUGGCUCCAGUUC | 221 |
| CGAGGGAGTTCTTCTTCTAG | 27 | HBVg_27 | 2386 | CGAGGGAGUUCUUCUUCUAG | 222 |
| GGGGCGCACCTCTCTTTACG | 28 | HBVg_28 | 1520 | GGGGCGCACCUCUCUUUACG | 223 |
| AGCTTGGAGGCTTGAACAGT | 29 | HBVg_29 | 1878 | AGCUUGGAGGCUUGAACAGU | 224 |
| AAGCCTCCAAGCTGTGCCTT | 30 | HBVg_30 | 1865 | AAGCCUCCAAGCUGUGCCUU | 225 |
| CCCCTGCTCGTGTTACAGGC | 31 | HBVg_31 | 184 | CCCCUGCUCGUGUUACAGGC | 226 |
| GCGAGGGAGTTCTTCTTCTA | 32 | HBVg_32 | 2387 | GCGAGGGAGUUCUUCUUCUA | 227 |
| TACTAGTGCCATTTGTTCAG | 33 | HBVg_33 | 677 | UACUAGUGCCAUUUGUUCAG | 228 |
| GACTTCTCTCAATTTTCTAG | 34 | HBVg_34 | 261 | GACUUCUCUCAAUUUUCUAG | 229 |

TABLE 4

Target site sequences and gRNA spacers with >90% HBV genomic conservation and 1-2 mismatches (HBV1)

| Target Site (protospacer) sequence | Target SEQ ID | Sequence name | Median HBV position | RNA spacer sequence | RNA spacer SEQ ID |
|---|---|---|---|---|---|
| ATTGACCCGTATAAAGAATT | 35 | HBVg_35 | 1906 | AUUGACCCGUAUAAAGAAUU | 230 |
| ACCCAAAGACAAAAGAAAAT | 36 | HBVg_36 | 825 | ACCCAAAGACAAAAGAAAAU | 231 |
| GTCCTCTTATGTAAGACCTT | 37 | HBVg_37 | 1663 | GUCCUCUUAUGUAAGACCUU | 232 |
| TGATCGGGAAAGAATCCCAG | 38 | HBVg_38 | 2930 | UGAUCGGGAAAGAAUCCCAG | 233 |
| TTTGCTGACGCAACCCCCAC | 39 | HBVg_39 | 1182 | UUUGCUGACGCAACCCCCAC | 234 |
| ATGAATCTAGCCACCTGGGT | 40 | HBVg_40 | 2095 | AUGAAUCUAGCCACCUGGGU | 235 |
| GGTCTCCATGCGACGTGCAG | 41 | HBVg_41 | 1616 | GGUCUCCAUGCGACGUGCAG | 236 |
| GGACTGAGGCCCACTCCCAT | 42 | HBVg_42 | 659 | GGACUGAGGCCCACUCCCAU | 237 |
| CACAGAGTCTAGACTCGTGG | 43 | HBVg_43 | 239 | CACAGAGUCUAGACUCGUGG | 238 |
| GAAGAACCAACAAGAAGATG | 44 | HBVg_44 | 446 | GAAGAACCAACAAGAAGAUG | 239 |
| ACACGGTCCGGCAGATGAGA | 45 | HBVg_45 | 1580 | ACACGGUCCGGCAGAUGAGA | 240 |
| GACATGAACATGAGATGATT | 46 | HBVg_46 | 1856 | GACAUGAACAUGAGAUGAUU | 241 |
| GCAGCACAGCCTAGCAGCCA | 47 | HBVg_47 | 1394 | GCAGCACAGCCUAGCAGCCA | 242 |
| TCCTGGAATTAGAGGACAAA | 48 | HBVg_48 | 490 | UCCUGGAAUUAGAGGACAAA | 243 |
| GTCTTACATAAGAGGACTCT | 49 | HBVg_49 | 1646 | GUCUUACAUAAGAGGACUCU | 244 |
| TTGTGGGTCACCATATTCTT | 50 | HBVg_50 | 2809 | UUGUGGGUCACCAUAUUCUU | 245 |
| CGCAAAATACCTATGGGAGT | 51 | HBVg_51 | 627 | CGCAAAAUACCUAUGGGAGU | 246 |
| GGGTTGCGTCAGCAAACACT | 52 | HBVg_52 | 1198 | GGGUUGCGUCAGCAAACACU | 247 |
| AGCTCTTGTTCCCAAGAATA | 53 | HBVg_53 | 2842 | AGCUCUUGUUCCCAAGAAUA | 248 |
| TGACATACTTTCCAATCAAT | 54 | HBVg_54 | 992 | UGACAUACUUUCCAAUCAAU | 249 |
| CAGATGAGAAGGCACAGACG | 55 | HBVg_55 | 1569 | CAGAUGAGAAGGCACAGACG | 250 |
| CCCCGCCTGTAACACGAGCA | 56 | HBVg_56 | 208 | CCCCGCCUGUAACACGAGCA | 251 |
| GGGTGGAGCCCTCAGGCTCA | 57 | HBVg_57 | 3072 | GGGUGGAGCCCUCAGGCUCA | 252 |
| ATTCCTTGGACTCATAAGGT | 58 | HBVg_58 | 2453 | AUUCCUUGGACUCAUAAGGU | 253 |
| TTTGTGGGTCACCATATTCT | 59 | HBVg_59 | 2808 | UUUGUGGGUCACCAUAUUCU | 254 |
| GTGAAAAGTTGCATGGTGC | 60 | HBVg_60 | 1828 | GUGAAAAGUUGCAUGGUGC | 255 |
| CCTGAACTGGAGCCACCAGC | 61 | HBVg_61 | 78 | CCUGAACUGGAGCCACCAGC | 256 |
| TCCTCTGCCGATCCATACTG | 62 | HBVg_62 | 1253 | UCCUCUGCCGAUCCAUACUG | 257 |

TABLE 4 -continued

Target site sequences and gRNA spacers with >90% HBV genomic conservation and 1-2 mismatches (HBV1)

| Target Site (protospacer) sequence | Target SEQ ID | Sequence name | Median HBV position | RNA spacer sequence | RNA spacer SEQ ID |
|---|---|---|---|---|---|
| CGGCTAGGAG TTCCGCAGTA | 63 | HBVg_63 | 1288 | CGGCUAGGAG UUCCGCAGUA | 258 |
| AATGTCAACG ACCGACCTTG | 64 | HBVg_64 | 1678 | AAUGUCAACG ACCGACCUUG | 259 |
| GACCTTCGTC TGCGAGGCGA | 65 | HBVg_65 | 2403 | GACCUUCGUC UGCGAGGCGA | 260 |
| GTTGCCGGGC AACGGGGTAA | 66 | HBVg_66 | 1162 | GUUGCCGGGC AACGGGGUAA | 261 |
| GATTGAGACC TTCGTCTGCG | 67 | HBVg_67 | 2409 | GAUUGAGACC UUCGUCUGCG | 262 |
| AGGACCCCTG CTCGTGTTAC | 68 | HBVg_68 | 180 | AGGACCCCUG CUCGUGUUAC | 263 |
| TTTGAAGTAT GCCTCAAGGT | 69 | HBVg_69 | 1712 | UUUGAAGUAU GCCUCAAGGU | 264 |
| CCGCTTGTTT TGCTCGCAGC | 70 | HBVg_70 | 1285 | CCGCUUGUUU UGCUCGCAGC | 265 |
| TGCTAGGCTG TGCTGCCAAC | 71 | HBVg_71 | 1378 | UGCUAGGCUG UGCUGCCAAC | 266 |
| TGCCGATTGG TGGAGGCAGG | 72 | HBVg_72 | 3146 | UGCCGAUUGG UGGAGGCAGG | 267 |
| TCTTTGTACT AGGAGGCTGT | 73 | HBVg_73 | 1764 | UCUUUGUACU AGGAGGCUGU | 268 |
| CGTCCCGCGC AGGATCCAGT | 74 | HBVg_74 | 1416 | CGUCCCGCGC AGGAUCCAGU | 269 |
| AAAGCCCAAG ATGATGGGAT | 75 | HBVg_75 | 627 | AAAGCCCAAG AUGAUGGGAU | 270 |
| GCAGATGAGA AGGCACAGAC | 76 | HBVg_76 | 1570 | GCAGAUGAGA AGGCACAGAC | 271 |
| CGATTGGTGG AGGCAGGAGG | 77 | HBVg_77 | 3143 | CGAUUGGUGG AGGCAGGAGG | 272 |
| AGGAGGCTGT AGGCATAAAT | 78 | HBVg_78 | 1774 | AGGAGGCUGU AGGCAUAAAU | 273 |
| CCATGCCCCA AAGCCACCCA | 79 | HBVg_79 | 1904 | CCAUGCCCCA AAGCCACCCA | 274 |
| AGGTTGGGGA CTGCGAATTT | 80 | HBVg_80 | 326 | AGGUUGGGGA CUGCGAAUUU | 275 |
| AGACCTTCGT CTGCGAGGCG | 81 | HBVg_81 | 2404 | AGACCUUCGU CUGCGAGGCG | 276 |
| CCTGGAATTA GAGGACAAAC | 82 | HBVg_82 | 489 | CCUGGAAUUA GAGGACAAAC | 277 |
| TTTCAGTTAT ATGGATGATG | 83 | HBVg_83 | 728 | UUUCAGUUAU AUGGAUGAUG | 278 |
| GTAACACGAG CAGGGGTCCT | 84 | HBVg_84 | 200 | GUAACACGAG CAGGGGUCCU | 279 |
| CATCTTCTTG TTGGTTCTTC | 85 | HBVg_85 | 426 | CAUCUUCUUG UUGGUUCUUC | 280 |
| CGGGGAGACC GCGTAAAGAG | 86 | HBVg_86 | 1551 | CGGGGAGACC GCGUAAAGAG | 281 |
| CTAGACTCTG TGGTATTGTG | 87 | HBVg_87 | 251 | CUAGACUCUG UGGUAUUGUG | 282 |
| CCCTGCTCGT GTTACAGGCG | 88 | HBVg_88 | 185 | CCCUGCUCGU GUUACAGGCG | 283 |
| TACCACAGAG TCTAGACTCG | 89 | HBVg_89 | 236 | UACCACAGAG UCUAGACUCG | 284 |
| TCGCAAAATA CCTATGGGAG | 90 | HBVg_90 | 626 | UCGCAAAAUA CCUAUGGGAG | 285 |
| GTCTGTGCCT TCTCATCTGC | 91 | HBVg_91 | 1550 | GUCUGUGCCU UCUCAUCUGC | 286 |
| ACACGTAGCG CCTCATTTTG | 92 | HBVg_92 | 2792 | ACACGUAGCG CCUCAUUUUG | 287 |
| TTGGGGTTGA GGTCCCAATC | 93 | HBVg_93 | 2990 | UUGGGGUUGA GGUCCCAAUC | 288 |
| CCCCGAGACG GGTCGTCCGC | 94 | HBVg_94 | 1469 | CCCCGAGACG GGUCGUCCGC | 289 |
| CCTACGAACC ACTGAACAAA | 95 | HBVg_95 | 708 | CCUACGAACC ACUGAACAAA | 290 |
| TTACATACTC TGTGGAAGGC | 96 | HBVg_96 | 2747 | UUACAUACUC UGUGGAAGGC | 291 |
| ACCTCCTTTC CATGGCTGCT | 97 | HBVg_97 | 1362 | ACCUCCUUUC CAUGGCUGCU | 292 |
| GTTATCGCTG GATGTGTCTG | 98 | HBVg_98 | 365 | GUUAUCGCUG GAUGUGUCUG | 293 |
| AACATGAGAT GATTAGGCAG | 99 | HBVg_99 | 1850 | AACAUGAGAU GAUUAGGCAG | 294 |
| ACTTCTCTCA ATTTTCTAGG | 100 | HBVg_100 | 262 | ACUUCUCUCA AUUUUCUAGG | 295 |

TABLE 5

Target site sequences and gRNA spacers with 70-90% HBV genomic conservation and up to 2 mismatches (HBV2)

| Target Site (protospacer) sequence | Target SEQ ID | Sequence name | Median HBV position | gRNA spacer sequence | RNA spacer SEQ ID |
|---|---|---|---|---|---|
| CACTTTCTCG CCAACTTACA | 101 | HBVg_101 | 1091 | CACUUUCUCG CCAACUUACA | 296 |
| CATAAGGTGG GAAACTTTAC | 102 | HBVg_102 | 2465 | CAUAAGGUGG GAAACUUUAC | 297 |
| CCAAACCTCG AAAAGGCATG | 103 | HBVg_103 | 2863 | CCAAACCUCG AAAAGGCAUG | 298 |

TABLE 5-continued

Target site sequences and gRNA spacers with 70-90% HBV genomic conservation and up to 2 mismatches (HBV2)

| Target Site (protospacer) sequence | Target SEQ ID | Sequence name | Median HBV position | gRNA spacer sequence | RNA spacer SEQ ID |
|---|---|---|---|---|---|
| ATAGAAGGAAAGAAGTCAGA | 104 | HBVg_104 | 1980 | AUAGAAGGAAAGAAGUCAGA | 299 |
| GCTGCTCCTTTTACACAATG | 105 | HBVg_105 | 1017 | GCUGCUCCUUUUACACAAUG | 300 |
| GAAGCGAAGTGCACACGGTC | 106 | HBVg_106 | 1592 | GAAGCGAAGUGCACACGGUC | 301 |
| GGATCATCAACCACCAGCAC | 107 | HBVg_107 | 487 | GGAUCAUCAACCACCAGCAC | 302 |
| GAGCCAAGAGAAACGGACTG | 108 | HBVg_108 | 673 | GAGCCAAGAGAAACGGACUG | 303 |
| CTTCACCTCTGCACGTCGCA | 109 | HBVg_109 | 1588 | CUUCACCUCUGCACGUCGCA | 304 |
| ACAATGTTCCGGAGACTCTA | 110 | HBVg_110 | 2044 | ACAAUGUUCCGGAGACUCUA | 305 |
| TCCGCGGGATTCAGCGCCGA | 111 | HBVg_111 | 1454 | UCCGCGGGAUUCAGCGCCGA | 306 |
| TTAATGAGTGGGAGGAGTTG | 112 | HBVg_112 | 1722 | UUAAUGAGUGGGAGGAGUUG | 307 |
| CCAACTCAAACAATCCAGAT | 113 | HBVg_113 | 2953 | CCAACUCAAACAAUCCAGAU | 308 |
| GCTGCCAACTGGATCCTGCG | 114 | HBVg_114 | 1389 | GCUGCCAACUGGAUCCUGCG | 309 |
| AGTCTTTGAAGTATGCCTCA | 115 | HBVg_115 | 1716 | AGUCUUUGAAGUAUGCCUCA | 310 |
| TCCTGACTGCCGATTGGTGG | 116 | HBVg_116 | 3153 | UCCUGACUGCCGAUUGGUGG | 311 |
| TCTTGTCCTCCAATTTGTCC | 117 | HBVg_117 | 343 | UCUUGUCCUCCAAUUUGUCC | 312 |
| CGATAACCAGGACAAATTGG | 118 | HBVg_118 | 372 | CGAUAACCAGGACAAAUUGG | 313 |
| ATTTGGAAGATCCAGCATCC | 119 | HBVg_119 | 2123 | AUUUGGAAGAUCCAGCAUCC | 314 |
| CTGTTTGGCTTTCAGTTATA | 120 | HBVg_120 | 719 | CUGUUUGGCUUUCAGUUAUA | 315 |
| CTCCTCCTGCCTCCACCAAT | 121 | HBVg_121 | 3121 | CUCCUCCUGCCUCCACCAAU | 316 |
| GTCATCCTCAGGCCATGCAG | 122 | HBVg_122 | 3190 | GUCAUCCUCAGGCCAUGCAG | 317 |
| CTGCCGTTCCGGCCGACCAC | 123 | HBVg_123 | 1500 | CUGCCGUUCCGGCCGACCAC | 318 |
| CCTTCCTGACTGCCGATTGG | 124 | HBVg_124 | 3156 | CCUUCCUGACUGCCGAUUGG | 319 |
| ACCTGCACGACTCCTGCTCA | 125 | HBVg_125 | 520 | ACCUGCACGACUCCUGCUCA | 320 |
| GGCCTGTATTTTCCTGCTGG | 126 | HBVg_126 | 43 | GGCCUGUAUUUUCCUGCUGG | 321 |
| AACATAGAGGTTCCTTGAGC | 127 | HBVg_127 | 555 | AACAUAGAGGUUCCUUGAGC | 322 |
| TGCCGTTCCGGCCGACCACG | 128 | HBVg_128 | 1501 | UGCCGUUCCGGCCGACCACG | 323 |
| ATAGGCCATCAGCGCATGCG | 129 | HBVg_129 | 1218 | AUAGGCCAUCAGCGCAUGCG | 324 |
| GCCTCCACCAATCGGCAGTC | 130 | HBVg_130 | 3129 | GCCUCCACCAAUCGGCAGUC | 325 |
| GTCCTTTGTTTACGTCCCGT | 131 | HBVg_131 | 1415 | GUCCUUUGUUUACGUCCCGU | 326 |
| TGGGAACAAGAGCTACAGCA | 132 | HBVg_132 | 2828 | UGGGAACAAGAGCUACAGCA | 327 |
| CTGTAAACAGGCCTATTGAT | 133 | HBVg_133 | 958 | CUGUAAACAGGCCUAUUGAU | 328 |
| GTCGCAGAAGATCTCAATCT | 134 | HBVg_134 | 2414 | GUCGCAGAAGAUCUCAAUCU | 329 |
| CTGCCTTCCTGACTGCCGAT | 135 | HBVg_135 | 3159 | CUGCCUUCCUGACUGCCGAU | 330 |
| ACTACTAATTCCCTGGATGC | 136 | HBVg_136 | 2157 | ACUACUAAUUCCCUGGAUGC | 331 |
| CACATTTCTTGCCTTACTTT | 137 | HBVg_137 | 2209 | CACAUUUCUUGCCUUACUUU | 332 |
| GGATGACTGTCTCTTAGAGG | 138 | HBVg_138 | 3197 | GGAUGACUGUCUCUUAGAGG | 333 |
| GCTATGCCTCATCTTCTTGT | 139 | HBVg_139 | 417 | GCUAUGCCUCAUCUUCUUGU | 334 |
| CCCGTCGGCGCTGAATCCCG | 140 | HBVg_140 | 1430 | CCCGUCGGCGCUGAAUCCCG | 335 |
| TAGTATTCCTTGGACTCATA | 141 | HBVg_141 | 2449 | UAGUAUUCCUUGGACUCAUA | 336 |
| AGGTAGGAGCGGGAGCATTC | 142 | HBVg_142 | 3016 | AGGUAGGAGCGGGAGCAUUC | 337 |
| TCTTTTGGGGTGGAGCCCTC | 143 | HBVg_143 | 3065 | UCUUUUGGGGUGGAGCCCUC | 338 |
| TCAGTATGCCTGAGCCTGA | 144 | HBVg_144 | 3103 | UCAGUAUGCCCUGAGCCUGA | 339 |
| TTTAATGAGTGGGAGGAGTT | 145 | HBVg_145 | 1721 | UUUAAUGAGUGGGAGGAGUU | 340 |
| CTCCCTCGCCTCGCAGACGA | 146 | HBVg_146 | 2378 | CUCCCUCGCCUCGCAGACGA | 341 |
| GATAAGATAGGGGCATTTGG | 147 | HBVg_147 | 2322 | GAUAAGAUAGGGGCAUUUGG | 342 |
| CCGCGGGATTCAGCGCCGAC | 148 | HBVg_148 | 1453 | CCGCGGGAUUCAGCGCCGAC | 343 |
| CAGCGATAACCAGGACAAAT | 149 | HBVg_149 | 375 | CAGCGAUAACCAGGACAAAU | 344 |

TABLE 5-continued

Target site sequences and gRNA spacers with 70-90% HBV genomic conservation and up to 2 mismatches (HBV2)

| Target Site (protospacer) sequence | Target SEQ ID | Sequence name | Median HBV position | gRNA spacer sequence | RNA spacer SEQ ID |
|---|---|---|---|---|---|
| CAGGTAGGAGTGGGAGCATT | 150 | HBVg_150 | 3021 | CAGGUAGGAGUGGGAGCAUU | 345 |
| GTTTAATGAGTGGGAGGAGT | 151 | HBVg_151 | 1720 | GUUUAAUGAGUGGGAGGAGU | 346 |
| TGGTGAGTGATTGGAGGTTG | 152 | HBVg_152 | 340 | UGGUGAGUGAUUGGAGGUUG | 347 |
| TAATGAGTGGGAGGAGTTGG | 153 | HBVg_153 | 1723 | UAAUGAGUGGGAGGAGUUGG | 348 |
| ACTACATGTTCTGGATAATA | 154 | HBVg_154 | 2719 | ACUACAUGUUCUGGAUAAUA | 349 |
| GGCATAGCAGCAGGATGAAG | 155 | HBVg_155 | 425 | GGCAUAGCAGCAGGAUGAAG | 350 |
| GTTGATAAGATAGGGGCATT | 156 | HBVg_156 | 2325 | GUUGAUAAGAUAGGGGCAUU | 351 |
| TCAACGAATTGTGGGTCTTT | 157 | HBVg_157 | 989 | UCAACGAAUUGUGGGUCUUU | 352 |
| TATGGATGATGTGGTATTGG | 158 | HBVg_158 | 737 | UAUGGAUGAUGUGGUAUUGG | 353 |
| CAACGAATTGTGGGTCTTTT | 159 | HBVg_159 | 990 | CAACGAAUUGUGGGUCUUUU | 354 |
| CATTTGTTCAGTGGTTCGTA | 160 | HBVg_160 | 686 | CAUUUGUUCAGUGGUUCGUA | 355 |
| CGTCTAACAACAGTAGTTTC | 161 | HBVg_161 | 2352 | CGUCUAACAACAGUAGUUUC | 356 |
| TGCCTGAGTGCTGTATGGTG | 162 | HBVg_162 | 2070 | UGCCUGAGUGCUGUAUGGUG | 357 |
| GCCCCGAGACGGGTCGTCCG | 163 | HBVg_163 | 1470 | GCCCCGAGACGGGUCGUCCG | 358 |
| GACTGCCGATTGGTGGAGGC | 164 | HBVg_164 | 3149 | GACUGCCGAUUGGUGGAGGC | 359 |
| TATATGGATGATGTGGTATT | 165 | HBVg_165 | 735 | UAUAUGGAUGAUGUGGUAUU | 360 |
| CTTGAGTATTTGGTGTCTTT | 166 | HBVg_166 | 2245 | CUUGAGUAUUUGGUGUCUUU | 361 |
| GATCTGGTGGGCGTTCACGG | 167 | HBVg_167 | 1637 | GAUCUGGUGGGCGUUCACGG | 362 |
| AGACTGGGAGGAGTTGGGGG | 168 | HBVg_168 | 1726 | AGACUGGGAGGAGUUGGGGG | 363 |
| AGTCCTCTTATGTAAGACCT | 169 | HBVg_169 | 1664 | AGUCCUCUUAUGUAAGACCU | 364 |
| CTCAAGATGTTGTACAGACT | 170 | HBVg_170 | 783 | CUCAAGAUGUUGUACAGACU | 365 |
| GGGAACAAGAGCTACAGCAT | 171 | HBVg_171 | 2829 | GGGAACAAGAGCUACAGCAU | 366 |
| TCGCAGAAGATCTCAATCTC | 172 | HBVg_172 | 2415 | UCGCAGAAGAUCUCAAUCUC | 367 |
| GGGGTGGAGCCCTCAGGCTC | 173 | HBVg_173 | 3071 | GGGGUGGAGCCCUCAGGCUC | 368 |
| TATTCCTTGGACTCATAAGG | 174 | HBVg_174 | 2452 | UAUUCCUUGGACUCAUAAGG | 369 |
| TCTAAGAGACAGTCATCCTC | 175 | HBVg_175 | 3179 | UCUAAGAGACAGUCAUCCUC | 370 |
| CAACTCAAACAATCCAGATT | 176 | HBVg_176 | 2954 | CAACUCAAACAAUCCAGAUU | 371 |
| AAACAAGGACGTCCCGCGC | 177 | HBVg_177 | 1426 | AAACAAGGACGUCCCGCGC | 372 |
| CTGCCAACTGGATCCTGCGC | 178 | HBVg_178 | 1390 | CUGCCAACUGGAUCCUGCGC | 373 |
| GAAGCTCCAAATTCTTTATA | 179 | HBVg_179 | 1935 | GAAGCUCCAAAUUCUUUAUA | 374 |
| GTCAGTATGCCCTGAGCCTG | 180 | HBVg_180 | 3104 | GUCAGUAUGCCCUGAGCCUG | 375 |
| TTTCCCACCTTATGAGTCCA | 181 | HBVg_181 | 2479 | UUUCCCACCUUAUGAGUCCA | 376 |
| ACAAGAGGTTGGTGAGTGAT | 182 | HBVg_182 | 349 | ACAAGAGGUUGGUGAGUGAU | 377 |
| GAAAGCCCAAGATGATGGGA | 183 | HBVg_183 | 628 | GAAAGCCCAAGAUGAUGGGA | 378 |
| AGGTTCCACGCATGCGCTGA | 184 | HBVg_184 | 1246 | AGGUUCCACGCAUGCGCUGA | 379 |
| TTGGTGAGTGATTGGAGGTT | 185 | HBVg_185 | 341 | UUGGUGAGUGAUUGGAGGUU | 380 |
| AGAGCTACAGCATGGGAGGT | 186 | HBVg_186 | 2836 | AGAGCUACAGCAUGGGAGGU | 381 |
| ATATGGATGATGTGGTATTG | 187 | HBVg_187 | 736 | AUAUGGAUGAUGUGGUAUUG | 382 |
| CCATTTGTTCAGTGGTTCGT | 188 | HBVg_188 | 685 | CCAUUUGUUCAGUGGUUCGU | 383 |
| TTATATGGATGATGTGGTAT | 189 | HBVg_189 | 734 | UUAUAUGGAUGAUGUGGUAU | 384 |
| GGAGTGGGAGCATTCGGGCC | 190 | HBVg_190 | 3021 | GGAGUGGGAGCAUUCGGGCC | 385 |
| ATTTGGTGTCTTTTGGAGTG | 191 | HBVg_191 | 2252 | AUUUGGUGUCUUUUGGAGUG | 386 |
| CACAGAAAGGCCTTGTAAGT | 192 | HBVg_192 | 1124 | CACAGAAAGGCCUUGUAAGU | 387 |
| ACCAATTTCTTTTGTCTTT | 193 | HBVg_193 | 801 | ACCAAUUUCUUUUGUCUUU | 388 |
| AGGTTAATGGTCTTTGTACT | 194 | HBVg_194 | 1754 | AGGUUAAUGGUCUUUGUACU | 389 |
| TACCAATTTTCTTTTGTCTT | 195 | HBVg_195 | 800 | UACCAAUUUUCUUUUGUCUU | 390 |

TABLE 6

Gene-targeting gRNAs

| Sequence name | Gene-targeting gRNAs | SEQ ID |
|---|---|---|
| HBVg_1 | CCCUAUCUUAUCAACACUUCGUUUAAGAGCUAUGCUGGAAACAGCAUAGCAAGUUUAAAUAAGGCUAGUCCGUUAUCAACUUGAAAAAGUGGCACCGAGUCGGUGC | 391 |
| HBVg_2 | GCAGAGGUGAAAAAGUUGCAGUUUAAGAGCUAUGCUGGAAACAGCAUAGCAAGUUUAAAUAAGGCUAGUCCGUUAUCAACUUGAAAAAGUGGCACCGAGUCGGUGC | 392 |
| HBVg_3 | UGGACUUCUCUCAAUUUUCUGUUUAAGAGCUAUGCUGGAAACAGCAUAGCAAGUUUAAAUAAGGCUAGUCCGUUAUCAACUUGAAAAAGUGGCACCGAGUCGGUGC | 393 |
| HBVg_4 | ACCCCGCCUGUAACACGAGCGUUUAAGAGCUAUGCUGGAAACAGCAUAGCAAGUUUAAAUAAGGCUAGUCCGUUAUCAACUUGAAAAAGUGGCACCGAGUCGGUGC | 394 |
| HBVg_5 | CCCGCCUGUAACACGAGCAGGUUUAAGAGCUAUGCUGGAAACAGCAUAGCAAGUUUAAAUAAGGCUAGUCCGUUAUCAACUUGAAAAAGUGGCACCGAGUCGGUGC | 395 |
| HBVg_6 | CACCACGAGUCUAGACUCUGGUUUAAGAGCUAUGCUGGAAACAGCAUAGCAAGUUUAAAUAAGGCUAGUCCGUUAUCAACUUGAAAAAGUGGCACCGAGUCGGUGC | 396 |
| HBVg_7 | GAGGUGAAGCGAAGUGCACAGUUUAAGAGCUAUGCUGGAAACAGCAUAGCAAGUUUAAAUAAGGCUAGUCCGUUAUCAACUUGAAAAAGUGGCACCGAGUCGGUGC | 397 |
| HBVg_8 | CCGGAAGUGUUGAUAAGAUAGUUUAAGAGCUAUGCUGGAAACAGCAUAGCAAGUUUAAAUAAGGCUAGUCCGUUAUCAACUUGAAAAAGUGGCACCGAGUCGGUGC | 398 |
| HBVg_9 | AGAAGAUGAGGCAUAGCAGCGUUUAAGAGCUAUGCUGGAAACAGCAUAGCAAGUUUAAAUAAGGCUAGUCCGUUAUCAACUUGAAAAAGUGGCACCGAGUCGGUGC | 399 |
| HBVg_10 | UCCGCAGUAUGGAUCGGCAGGUUUAAGAGCUAUGCUGGAAACAGCAUAGCAAGUUUAAAUAAGGCUAGUCCGUUAUCAACUUGAAAAAGUGGCACCGAGUCGGUGC | 400 |
| HBVg_11 | GGACUUCUCUCAAUUUUCUAGUUUAAGAGCUAUGCUGGAAACAGCAUAGCAAGUUUAAAUAAGGCUAGUCCGUUAUCAACUUGAAAAAGUGGCACCGAGUCGGUGC | 401 |
| HBVg_12 | CCACCCAAGGCACAGCUUGGGUUUAAGAGCUAUGCUGGAAACAGCAUAGCAAGUUUAAAUAAGGCUAGUCCGUUAUCAACUUGAAAAAGUGGCACCGAGUCGGUGC | 402 |
| HBVg_13 | AGAGAGGUGCGCCCCGUGGUGUUUAAGAGCUAUGCUGGAAACAGCAUAGCAAGUUUAAAUAAGGCUAGUCCGUUAUCAACUUGAAAAAGUGGCACCGAGUCGGUGC | 403 |
| HBVg_14 | GAUUGAGAUCUUCUGCGACGGUUUAAGAGCUAUGCUGGAAACAGCAUAGCAAGUUUAAAUAAGGCUAGUCCGUUAUCAACUUGAAAAAGUGGCACCGAGUCGGUGC | 404 |
| HBVg_15 | CAAGCCUCCAAGCUGUGCCUGUUUAAGAGCUAUGCUGGAAACAGCAUAGCAAGUUUAAAUAAGGCUAGUCCGUUAUCAACUUGAAAAAGUGGCACCGAGUCGGUGC | 405 |
| HBVg_16 | GGCGAGGGAGUUCUUCUUCUGUUUAAGAGCUAUGCUGGAAACAGCAUAGCAAGUUUAAAUAAGGCUAGUCCGUUAUCAACUUGAAAAAGUGGCACCGAGUCGGUGC | 406 |
| HBVg_17 | UCCGGAAGUGUUGAUAAGAUGUUUAAGAGCUAUGCUGGAAACAGCAUAGCAAGUUUAAAUAAGGCUAGUCCGUUAUCAACUUGAAAAAGUGGCACCGAGUCGGUGC | 407 |
| HBVg_18 | AAGCCACCCAAGGCACAGCUGUUUAAGAGCUAUGCUGGAAACAGCAUAGCAAGUUUAAAUAAGGCUAGUCCGUUAUCAACUUGAAAAAGUGGCACCGAGUCGGUGC | 408 |
| HBVg_19 | CCUCCAAGCUGUGCCUUGGGGUUUAAGAGCUAUGCUGGAAACAGCAUAGCAAGUUUAAAUAAGGCUAGUCCGUUAUCAACUUGAAAAAGUGGCACCGAGUCGGUGC | 409 |

TABLE 6-continued

Gene-targeting gRNAs

| Sequence name | Gene-targeting gRNAs | SEQ ID |
|---|---|---|
| HBVg_20 | GUAAAGAGAGGUGCGCCCCGGUUUAAGAGCUAUGCUGGAAACAGCAUAGC AAGUUUAAAUAAGGCUAGUCCGUUAUCAACUUGAAAAAGUGGCACCGAGU CGGUGC | 410 |
| HBVg_21 | GGCAGAUGAGAAGGCACAGAGUUUAAGAGCUAUGCUGGAAACAGCAUAGC AAGUUUAAAUAAGGCUAGUCCGUUAUCAACUUGAAAAAGUGGCACCGAGU CGGUGC | 411 |
| HBVg_22 | AGGAGUUCCGCAGUAUGGAUGUUUAAGAGCUAUGCUGGAAACAGCAUAGC AAGUUUAAAUAAGGCUAGUCCGUUAUCAACUUGAAAAAGUGGCACCGAGU CGGUGC | 412 |
| HBVg_23 | GCUGUGCCUUGGGUGGCUUUGUUUAAGAGCUAUGCUGGAAACAGCAUAGC AAGUUUAAAUAAGGCUAGUCCGUUAUCAACUUGAAAAAGUGGCACCGAGU CGGUGC | 413 |
| HBVg_24 | ACCCCUGCUCGUGUUACAGGGUUUAAGAGCUAUGCUGGAAACAGCAUAGC AAGUUUAAAUAAGGCUAGUCCGUUAUCAACUUGAAAAAGUGGCACCGAGU CGGUGC | 414 |
| HBVg_25 | CGGAAGUGUUGAUAAGAUAGGUUUAAGAGCUAUGCUGGAAACAGCAUAGC AAGUUUAAAUAAGGCUAGUCCGUUAUCAACUUGAAAAAGUGGCACCGAGU CGGUGC | 415 |
| HBVg_26 | CCUGCUGGUGGCUCCAGUUCGUUUAAGAGCUAUGCUGGAAACAGCAUAGC AAGUUUAAAUAAGGCUAGUCCGUUAUCAACUUGAAAAAGUGGCACCGAGU CGGUGC | 416 |
| HBVg_27 | CGAGGGAGUUCUUCUUCUAGGUUUAAGAGCUAUGCUGGAAACAGCAUAGC AAGUUUAAAUAAGGCUAGUCCGUUAUCAACUUGAAAAAGUGGCACCGAGU CGGUGC | 417 |
| HBVg_28 | GGGGCGCACCUCUCUUUACGGUUUAAGAGCUAUGCUGGAAACAGCAUAGC AAGUUUAAAUAAGGCUAGUCCGUUAUCAACUUGAAAAAGUGGCACCGAGU CGGUGC | 418 |
| HBVg_29 | AGCUUGGAGGCUUGAACAGUGUUUAAGAGCUAUGCUGGAAACAGCAUAGC AAGUUUAAAUAAGGCUAGUCCGUUAUCAACUUGAAAAAGUGGCACCGAGU CGGUGC | 419 |
| HBVg_30 | AAGCCUCCAAGCUGUGCCUUGUUUAAGAGCUAUGCUGGAAACAGCAUAGC AAGUUUAAAUAAGGCUAGUCCGUUAUCAACUUGAAAAAGUGGCACCGAGU CGGUGC | 420 |
| HBVg_31 | CCCCUGCUCGUGUUACAGGCGUUUAAGAGCUAUGCUGGAAACAGCAUAGC AAGUUUAAAUAAGGCUAGUCCGUUAUCAACUUGAAAAAGUGGCACCGAGU CGGUGC | 421 |
| HBVg_32 | GCGAGGGAGUUCUUCUUCUAGUUUAAGAGCUAUGCUGGAAACAGCAUAGC AAGUUUAAAUAAGGCUAGUCCGUUAUCAACUUGAAAAAGUGGCACCGAGU CGGUGC | 422 |
| HBVg_33 | UACUAGUGCCAUUUGUUCAGGUUUAAGAGCUAUGCUGGAAACAGCAUAGC AAGUUUAAAUAAGGCUAGUCCGUUAUCAACUUGAAAAAGUGGCACCGAGU CGGUGC | 423 |
| HBVg_34 | GACUUCUCUCAAUUUUCUAGGUUUAAGAGCUAUGCUGGAAACAGCAUAGC AAGUUUAAAUAAGGCUAGUCCGUUAUCAACUUGAAAAAGUGGCACCGAGU CGGUGC | 424 |
| HBVg_35 | AUUGACCCGUAUAAAGAAUUGUUUAAGAGCUAUGCUGGAAACAGCAUAGC AAGUUUAAAUAAGGCUAGUCCGUUAUCAACUUGAAAAAGUGGCACCGAGU CGGUGC | 425 |
| HBVg_36 | ACCCAAAGACAAAAGAAAAUGUUUAAGAGCUAUGCUGGAAACAGCAUAGC AAGUUUAAAUAAGGCUAGUCCGUUAUCAACUUGAAAAAGUGGCACCGAGU CGGUGC | 426 |
| HBVg_37 | GUCCUCUUAUGUAAGACCUUGUUUAAGAGCUAUGCUGGAAACAGCAUAGC AAGUUUAAAUAAGGCUAGUCCGUUAUCAACUUGAAAAAGUGGCACCGAGU CGGUGC | 427 |

TABLE 6-continued

Gene-targeting gRNAs

| Sequence name | Gene-targeting gRNAs | SEQ ID |
|---|---|---|
| HBVg_38 | UGAUCGGGAAAGAAUCCCAGGUUUAAGAGCUAUGCUGGAAACAGCAUAGC AAGUUUAAAUAAGGCUAGUCCGUUAUCAACUUGAAAAAGUGGCACCGAGU CGGUGC | 428 |
| HBVg_39 | UUUGCUGACGCAACCCCCACGUUUAAGAGCUAUGCUGGAAACAGCAUAGC AAGUUUAAAUAAGGCUAGUCCGUUAUCAACUUGAAAAAGUGGCACCGAGU CGGUGC | 429 |
| HBVg_40 | AUGAAUCUAGCCACCUGGGUGUUUAAGAGCUAUGCUGGAAACAGCAUAGC AAGUUUAAAUAAGGCUAGUCCGUUAUCAACUUGAAAAAGUGGCACCGAGU CGGUGC | 430 |
| HBVg_41 | GGUCUCCAUGCGACGUGCAGGUUUAAGAGCUAUGCUGGAAACAGCAUAGC AAGUUUAAAUAAGGCUAGUCCGUUAUCAACUUGAAAAAGUGGCACCGAGU CGGUGC | 431 |
| HBVg_42 | GGACUGAGGCCCACUCCCAUGUUUAAGAGCUAUGCUGGAAACAGCAUAGC AAGUUUAAAUAAGGCUAGUCCGUUAUCAACUUGAAAAAGUGGCACCGAGU CGGUGC | 432 |
| HBVg_43 | CACAGAGUCUAGACUCGUGGGUUUAAGAGCUAUGCUGGAAACAGCAUAGC AAGUUUAAAUAAGGCUAGUCCGUUAUCAACUUGAAAAAGUGGCACCGAGU CGGUGC | 433 |
| HBVg_44 | GAAGAACCAACAAGAAGAUGGUUUAAGAGCUAUGCUGGAAACAGCAUAGC AAGUUUAAAUAAGGCUAGUCCGUUAUCAACUUGAAAAAGUGGCACCGAGU CGGUGC | 434 |
| HBVg_45 | ACACGGUCCGGCAGAUGAGAGUUUAAGAGCUAUGCUGGAAACAGCAUAGC AAGUUUAAAUAAGGCUAGUCCGUUAUCAACUUGAAAAAGUGGCACCGAGU CGGUGC | 435 |
| HBVg_46 | GACAUGAACAUGAGAUGAUUGUUUAAGAGCUAUGCUGGAAACAGCAUAGC AAGUUUAAAUAAGGCUAGUCCGUUAUCAACUUGAAAAAGUGGCACCGAGU CGGUGC | 436 |
| HBVg_47 | GCAGCACAGCCUAGCAGCCAGUUUAAGAGCUAUGCUGGAAACAGCAUAGC AAGUUUAAAUAAGGCUAGUCCGUUAUCAACUUGAAAAAGUGGCACCGAGU CGGUGC | 437 |
| HBVg_48 | UCCUGGAAUUAGAGGACAAAGUUUAAGAGCUAUGCUGGAAACAGCAUAGC AAGUUUAAAUAAGGCUAGUCCGUUAUCAACUUGAAAAAGUGGCACCGAGU CGGUGC | 438 |
| HBVg_49 | GUCUUACAUAAGAGGACUCUGUUUAAGAGCUAUGCUGGAAACAGCAUAGC AAGUUUAAAUAAGGCUAGUCCGUUAUCAACUUGAAAAAGUGGCACCGAGU CGGUGC | 439 |
| HBVg_50 | UUGUGGGUCACCAUAUUCUUGUUUAAGAGCUAUGCUGGAAACAGCAUAGC AAGUUUAAAUAAGGCUAGUCCGUUAUCAACUUGAAAAAGUGGCACCGAGU CGGUGC | 440 |
| HBVg_51 | CGCAAAAUACCUAUGGGAGUGUUUAAGAGCUAUGCUGGAAACAGCAUAGC AAGUUUAAAUAAGGCUAGUCCGUUAUCAACUUGAAAAAGUGGCACCGAGU CGGUGC | 441 |
| HBVg_52 | GGGUUGCGUCAGCAAACACUGUUUAAGAGCUAUGCUGGAAACAGCAUAGC AAGUUUAAAUAAGGCUAGUCCGUUAUCAACUUGAAAAAGUGGCACCGAGU CGGUGC | 442 |
| HBVg_53 | AGCUCUUGUUCCCAAGAAUAGUUUAAGAGCUAUGCUGGAAACAGCAUAGC AAGUUUAAAUAAGGCUAGUCCGUUAUCAACUUGAAAAAGUGGCACCGAGU CGGUGC | 443 |
| HBVg_54 | UGACAUACUUUCCAAUCAAUGUUUAAGAGCUAUGCUGGAAACAGCAUAGC AAGUUUAAAUAAGGCUAGUCCGUUAUCAACUUGAAAAAGUGGCACCGAGU CGGUGC | 444 |
| HBVg_55 | CAGAUGAGAAGGCACAGACGGUUUAAGAGCUAUGCUGGAAACAGCAUAGC AAGUUUAAAUAAGGCUAGUCCGUUAUCAACUUGAAAAAGUGGCACCGAGU CGGUGC | 445 |

TABLE 6-continued

Gene-targeting gRNAs

| Sequence name | Gene-targeting gRNAs | SEQ ID |
|---|---|---|
| HBVg_56 | CCCCGCCUGUAACACGAGCAGUUUAAGAGCUAUGCUGGAAACAGCAUAGC<br>AAGUUUAAAUAAGGCUAGUCCGUUAUCAACUUGAAAAAGUGGCACCGAGU<br>CGGUGC | 446 |
| HBVg_57 | GGGUGGAGCCCUCAGGCUCAGUUUAAGAGCUAUGCUGGAAACAGCAUAGC<br>AAGUUUAAAUAAGGCUAGUCCGUUAUCAACUUGAAAAAGUGGCACCGAGU<br>CGGUGC | 447 |
| HBVg_58 | AUUCCUUGGACUCAUAAGGUGUUUAAGAGCUAUGCUGGAAACAGCAUAGC<br>AAGUUUAAAUAAGGCUAGUCCGUUAUCAACUUGAAAAAGUGGCACCGAGU<br>CGGUGC | 448 |
| HBVg_59 | UUUGUGGGUCACCAUAUUCUGUUUAAGAGCUAUGCUGGAAACAGCAUAGC<br>AAGUUUAAAUAAGGCUAGUCCGUUAUCAACUUGAAAAAGUGGCACCGAGU<br>CGGUGC | 449 |
| HBVg_60 | GUGAAAAGUUGCAUGGUGCGUUUAAGAGCUAUGCUGGAAACAGCAUAGC<br>AAGUUUAAAUAAGGCUAGUCCGUUAUCAACUUGAAAAAGUGGCACCGAGU<br>CGGUGC | 450 |
| HBVg_61 | CCUGAACUGGAGCCACCAGCGUUUAAGAGCUAUGCUGGAAACAGCAUAGC<br>AAGUUUAAAUAAGGCUAGUCCGUUAUCAACUUGAAAAAGUGGCACCGAGU<br>CGGUGC | 451 |
| HBVg_62 | UCCUCUGCCGAUCCAUACUGGUUUAAGAGCUAUGCUGGAAACAGCAUAGC<br>AAGUUUAAAUAAGGCUAGUCCGUUAUCAACUUGAAAAAGUGGCACCGAGU<br>CGGUGC | 452 |
| HBVg_63 | CGGCUAGGAGUUCCGCAGUAGUUUAAGAGCUAUGCUGGAAACAGCAUAGC<br>AAGUUUAAAUAAGGCUAGUCCGUUAUCAACUUGAAAAAGUGGCACCGAGU<br>CGGUGC | 453 |
| HBVg_64 | AAUGUCAACGACCGACCUUGGUUUAAGAGCUAUGCUGGAAACAGCAUAGC<br>AAGUUUAAAUAAGGCUAGUCCGUUAUCAACUUGAAAAAGUGGCACCGAGU<br>CGGUGC | 454 |
| HBVg_65 | GACCUUCGUCUGCGAGGCGAGUUUAAGAGCUAUGCUGGAAACAGCAUAGC<br>AAGUUUAAAUAAGGCUAGUCCGUUAUCAACUUGAAAAAGUGGCACCGAGU<br>CGGUGC | 455 |
| HBVg_66 | GUUGCCGGGCAACGGGUAAGUUUAAGAGCUAUGCUGGAAACAGCAUAGC<br>AAGUUUAAAUAAGGCUAGUCCGUUAUCAACUUGAAAAAGUGGCACCGAGU<br>CGGUGC | 456 |
| HBVg_67 | GAUUGAGACCUUCGUCUGCGGUUUAAGAGCUAUGCUGGAAACAGCAUAGC<br>AAGUUUAAAUAAGGCUAGUCCGUUAUCAACUUGAAAAAGUGGCACCGAGU<br>CGGUGC | 457 |
| HBVg_68 | AGGACCCCUGCUCGUGUUACGUUUAAGAGCUAUGCUGGAAACAGCAUAGC<br>AAGUUUAAAUAAGGCUAGUCCGUUAUCAACUUGAAAAAGUGGCACCGAGU<br>CGGUGC | 458 |
| HBVg_69 | UUUGAAGUAUGCCUCAAGGUGUUUAAGAGCUAUGCUGGAAACAGCAUAGC<br>AAGUUUAAAUAAGGCUAGUCCGUUAUCAACUUGAAAAAGUGGCACCGAGU<br>CGGUGC | 459 |
| HBVg_70 | CCGCUUGUUUUGCUCGCAGCGUUUAAGAGCUAUGCUGGAAACAGCAUAGC<br>AAGUUUAAAUAAGGCUAGUCCGUUAUCAACUUGAAAAAGUGGCACCGAGU<br>CGGUGC | 460 |
| HBVg_71 | UGCUAGGCUGUGCUGCCAACGUUUAAGAGCUAUGCUGGAAACAGCAUAGC<br>AAGUUUAAAUAAGGCUAGUCCGUUAUCAACUUGAAAAAGUGGCACCGAGU<br>CGGUGC | 461 |
| HBVg_72 | UGCCGAUUGGUGGAGGCAGGGUUUAAGAGCUAUGCUGGAAACAGCAUAGC<br>AAGUUUAAAUAAGGCUAGUCCGUUAUCAACUUGAAAAAGUGGCACCGAGU<br>CGGUGC | 462 |
| HBVg_73 | UCUUUGUACUAGGAGGCUGUGUUUAAGAGCUAUGCUGGAAACAGCAUAGC<br>AAGUUUAAAUAAGGCUAGUCCGUUAUCAACUUGAAAAAGUGGCACCGAGU<br>CGGUGC | 463 |

TABLE 6-continued

Gene-targeting gRNAs

| Sequence name | Gene-targeting gRNAs | SEQ ID |
|---|---|---|
| HBVg_74 | CGUCCCGCGCAGGAUCCAGUGUUUAAGAGCUAUGCUGGAAACAGCAUAGC AAGUUUAAAUAAGGCUAGUCCGUUAUCAACUUGAAAAAGUGGCACCGAGU CGGUGC | 464 |
| HBVg_75 | AAAGCCCAAGAUGAUGGGAUGUUUAAGAGCUAUGCUGGAAACAGCAUAGC AAGUUUAAAUAAGGCUAGUCCGUUAUCAACUUGAAAAAGUGGCACCGAGU CGGUGC | 465 |
| HBVg_76 | GCAGAUGAGAAGGCACAGACGUUUAAGAGCUAUGCUGGAAACAGCAUAGC AAGUUUAAAUAAGGCUAGUCCGUUAUCAACUUGAAAAAGUGGCACCGAGU CGGUGC | 466 |
| HBVg_77 | CGAUUGGUGGAGGCAGGAGGGUUUAAGAGCUAUGCUGGAAACAGCAUAGC AAGUUUAAAUAAGGCUAGUCCGUUAUCAACUUGAAAAAGUGGCACCGAGU CGGUGC | 467 |
| HBVg_78 | AGGAGGCUGUAGGCAUAAAUGUUUAAGAGCUAUGCUGGAAACAGCAUAGC AAGUUUAAAUAAGGCUAGUCCGUUAUCAACUUGAAAAAGUGGCACCGAGU CGGUGC | 468 |
| HBVg_79 | CCAUGCCCCAAAGCCACCCAGUUUAAGAGCUAUGCUGGAAACAGCAUAGC AAGUUUAAAUAAGGCUAGUCCGUUAUCAACUUGAAAAAGUGGCACCGAGU CGGUGC | 469 |
| HBVg_80 | AGGUUGGGGACUGCGAAUUUGUUUAAGAGCUAUGCUGGAAACAGCAUAGC AAGUUUAAAUAAGGCUAGUCCGUUAUCAACUUGAAAAAGUGGCACCGAGU CGGUGC | 470 |
| HBVg_81 | AGACCUUCGUCUGCGAGGCGGUUUAAGAGCUAUGCUGGAAACAGCAUAGC AAGUUUAAAUAAGGCUAGUCCGUUAUCAACUUGAAAAAGUGGCACCGAGU CGGUGC | 471 |
| HBVg_82 | CCUGGAAUUAGAGGACAAACGUUUAAGAGCUAUGCUGGAAACAGCAUAGC AAGUUUAAAUAAGGCUAGUCCGUUAUCAACUUGAAAAAGUGGCACCGAGU CGGUGC | 472 |
| HBVg_83 | UUUCAGUUAUAUGGAUGAUGGUUUAAGAGCUAUGCUGGAAACAGCAUAGC AAGUUUAAAUAAGGCUAGUCCGUUAUCAACUUGAAAAAGUGGCACCGAGU CGGUGC | 473 |
| HBVg_84 | GUAACACGAGCAGGGGUCCUGUUUAAGAGCUAUGCUGGAAACAGCAUAGC AAGUUUAAAUAAGGCUAGUCCGUUAUCAACUUGAAAAAGUGGCACCGAGU CGGUGC | 474 |
| HBVg_85 | CAUCUUCUUGUUGGUUCUUCGUUUAAGAGCUAUGCUGGAAACAGCAUAGC AAGUUUAAAUAAGGCUAGUCCGUUAUCAACUUGAAAAAGUGGCACCGAGU CGGUGC | 475 |
| HBVg_86 | CGGGGAGACCGCGUAAAGAGGUUUAAGAGCUAUGCUGGAAACAGCAUAGC AAGUUUAAAUAAGGCUAGUCCGUUAUCAACUUGAAAAAGUGGCACCGAGU CGGUGC | 476 |
| HBVg_87 | CUAGACUCUGUGGUAUUGUGGUUUAAGAGCUAUGCUGGAAACAGCAUAGC AAGUUUAAAUAAGGCUAGUCCGUUAUCAACUUGAAAAAGUGGCACCGAGU CGGUGC | 477 |
| HBVg_88 | CCCUGCUCUGUGUUACAGGCGGUUUAAGAGCUAUGCUGGAAACAGCAUAGC AAGUUUAAAUAAGGCUAGUCCGUUAUCAACUUGAAAAAGUGGCACCGAGU CGGUGC | 478 |
| HBVg_89 | UACCACAGAGUCUAGACUCGGUUUAAGAGCUAUGCUGGAAACAGCAUAGC AAGUUUAAAUAAGGCUAGUCCGUUAUCAACUUGAAAAAGUGGCACCGAGU CGGUGC | 479 |
| HBVg_90 | UCGCAAAAUACCUAUGGGAGGUUUAAGAGCUAUGCUGGAAACAGCAUAGC AAGUUUAAAUAAGGCUAGUCCGUUAUCAACUUGAAAAAGUGGCACCGAGU CGGUGC | 480 |
| HBVg_91 | GUCUGUGCCUUCUCAUCUGCGUUUAAGAGCUAUGCUGGAAACAGCAUAGC AAGUUUAAAUAAGGCUAGUCCGUUAUCAACUUGAAAAAGUGGCACCGAGU CGGUGC | 481 |

TABLE 6-continued

Gene-targeting gRNAs

| Sequence name | Gene-targeting gRNAs | SEQ ID |
|---|---|---|
| HBVg_92 | ACACGUAGCGCCUCAUUUUGGUUUAAGAGCUAUGCUGGAAACAGCAUAGC AAGUUUAAAUAAGGCUAGUCCGUUAUCAACUUGAAAAAGUGGCACCGAGU CGGUGC | 482 |
| HBVg_93 | UUGGGGUUGAGGUCCCAAUCGUUUAAGAGCUAUGCUGGAAACAGCAUAGC AAGUUUAAAUAAGGCUAGUCCGUUAUCAACUUGAAAAAGUGGCACCGAGU CGGUGC | 483 |
| HBVg_94 | CCCCGAGACGGGUCGUCCGCGUUUAAGAGCUAUGCUGGAAACAGCAUAGC AAGUUUAAAUAAGGCUAGUCCGUUAUCAACUUGAAAAAGUGGCACCGAGU CGGUGC | 484 |
| HBVg_95 | CCUACGAACCACUGAACAAAGUUUAAGAGCUAUGCUGGAAACAGCAUAGC AAGUUUAAAUAAGGCUAGUCCGUUAUCAACUUGAAAAAGUGGCACCGAGU CGGUGC | 485 |
| HBVg_96 | UUACAUACUCUGUGGAAGGCGUUUAAGAGCUAUGCUGGAAACAGCAUAGC AAGUUUAAAUAAGGCUAGUCCGUUAUCAACUUGAAAAAGUGGCACCGAGU CGGUGC | 486 |
| HBVg_97 | ACCUCCUUUCCAUGGCUGCUGUUUAAGAGCUAUGCUGGAAACAGCAUAGC AAGUUUAAAUAAGGCUAGUCCGUUAUCAACUUGAAAAAGUGGCACCGAGU CGGUGC | 487 |
| HBVg_98 | GUUAUCGCUGGAUGUGUCUGGUUUAAGAGCUAUGCUGGAAACAGCAUAGC AAGUUUAAAUAAGGCUAGUCCGUUAUCAACUUGAAAAAGUGGCACCGAGU CGGUGC | 488 |
| HBVg_99 | AACAUGAGAUGAUUAGGCAGGUUUAAGAGCUAUGCUGGAAACAGCAUAGC AAGUUUAAAUAAGGCUAGUCCGUUAUCAACUUGAAAAAGUGGCACCGAGU CGGUGC | 489 |
| HBVg_100 | ACUUCUCUCAAUUUUCUAGGGUUUAAGAGCUAUGCUGGAAACAGCAUAGC AAGUUUAAAUAAGGCUAGUCCGUUAUCAACUUGAAAAAGUGGCACCGAGU CGGUGC | 490 |
| HBVg_101 | CACUUUCUCGCCAACUUACAGUUUAAGAGCUAUGCUGGAAACAGCAUAGC AAGUUUAAAUAAGGCUAGUCCGUUAUCAACUUGAAAAAGUGGCACCGAGU CGGUGC | 491 |
| HBVg_102 | CAUAAGGUGGGAAACUUUACGUUUAAGAGCUAUGCUGGAAACAGCAUAGC AAGUUUAAAUAAGGCUAGUCCGUUAUCAACUUGAAAAAGUGGCACCGAGU CGGUGC | 492 |
| HBVg_103 | CCAAACCUCGAAAAGGCAUGGUUUAAGAGCUAUGCUGGAAACAGCAUAGC AAGUUUAAAUAAGGCUAGUCCGUUAUCAACUUGAAAAAGUGGCACCGAGU CGGUGC | 493 |
| HBVg_104 | AUAGAAGGAAAGAAGUCAGAGUUUAAGAGCUAUGCUGGAAACAGCAUAGC AAGUUUAAAUAAGGCUAGUCCGUUAUCAACUUGAAAAAGUGGCACCGAGU CGGUGC | 494 |
| HBVg_105 | GCUGCUCCUUUUACACAAUGGUUUAAGAGCUAUGCUGGAAACAGCAUAGC AAGUUUAAAUAAGGCUAGUCCGUUAUCAACUUGAAAAAGUGGCACCGAGU CGGUGC | 495 |
| HBVg_106 | GAAGCGAAGUGCACACGGUCGUUUAAGAGCUAUGCUGGAAACAGCAUAGC AAGUUUAAAUAAGGCUAGUCCGUUAUCAACUUGAAAAAGUGGCACCGAGU CGGUGC | 496 |
| HBVg_107 | GGAUCAUCAACCACCAGCACGUUUAAGAGCUAUGCUGGAAACAGCAUAGC AAGUUUAAAUAAGGCUAGUCCGUUAUCAACUUGAAAAAGUGGCACCGAGU CGGUGC | 497 |
| HBVg_108 | GAGCCAAGAGAAACGGACUGGUUUAAGAGCUAUGCUGGAAACAGCAUAGC AAGUUUAAAUAAGGCUAGUCCGUUAUCAACUUGAAAAAGUGGCACCGAGU CGGUGC | 498 |
| HBVg_109 | CUUCACCUCUGCACGUCGCAGUUUAAGAGCUAUGCUGGAAACAGCAUAGC AAGUUUAAAUAAGGCUAGUCCGUUAUCAACUUGAAAAAGUGGCACCGAGU CGGUGC | 499 |

TABLE 6-continued

Gene-targeting gRNAs

| Sequence name | Gene-targeting gRNAs | SEQ ID |
|---|---|---|
| HBVg_110 | ACAAUGUUCCGGAGACUCUAGUUUAAGAGCUAUGCUGGAAACAGCAUAGCAAGUUUAAAUAAGGCUAGUCCGUUAUCAACUUGAAAAAGUGGCACCGAGUCGGUGC | 500 |
| HBVg_111 | UCCGCGGGAUUCAGCGCCGAGUUUAAGAGCUAUGCUGGAAACAGCAUAGCAAGUUUAAAUAAGGCUAGUCCGUUAUCAACUUGAAAAAGUGGCACCGAGUCGGUGC | 501 |
| HBVg_112 | UUAAUGAGUGGGAGGAGUUGGUUUAAGAGCUAUGCUGGAAACAGCAUAGCAAGUUUAAAUAAGGCUAGUCCGUUAUCAACUUGAAAAAGUGGCACCGAGUCGGUGC | 502 |
| HBVg_113 | CCAACUCAAACAAUCCAGAUGUUUAAGAGCUAUGCUGGAAACAGCAUAGCAAGUUUAAAUAAGGCUAGUCCGUUAUCAACUUGAAAAAGUGGCACCGAGUCGGUGC | 503 |
| HBVg_114 | GCUGCCAACUGGAUCCUGCGGUUUAAGAGCUAUGCUGGAAACAGCAUAGCAAGUUUAAAUAAGGCUAGUCCGUUAUCAACUUGAAAAAGUGGCACCGAGUCGGUGC | 504 |
| HBVg_115 | AGUCUUUGAAGUAUGCCUCAGUUUAAGAGCUAUGCUGGAAACAGCAUAGCAAGUUUAAAUAAGGCUAGUCCGUUAUCAACUUGAAAAAGUGGCACCGAGUCGGUGC | 505 |
| HBVg_116 | UCCUGACUGCCGAUUGGUGGGUUUAAGAGCUAUGCUGGAAACAGCAUAGCAAGUUUAAAUAAGGCUAGUCCGUUAUCAACUUGAAAAAGUGGCACCGAGUCGGUGC | 506 |
| HBVg_117 | UCUUGUCCUCCAAUUUGUCCGUUUAAGAGCUAUGCUGGAAACAGCAUAGCAAGUUUAAAUAAGGCUAGUCCGUUAUCAACUUGAAAAAGUGGCACCGAGUCGGUGC | 507 |
| HBVg_118 | CGAUAACCAGGACAAAUUGGGUUUAAGAGCUAUGCUGGAAACAGCAUAGCAAGUUUAAAUAAGGCUAGUCCGUUAUCAACUUGAAAAAGUGGCACCGAGUCGGUGC | 508 |
| HBVg_119 | AUUUGGAAGAUCCAGCAUCCGUUUAAGAGCUAUGCUGGAAACAGCAUAGCAAGUUUAAAUAAGGCUAGUCCGUUAUCAACUUGAAAAAGUGGCACCGAGUCGGUGC | 509 |
| HBVg_120 | CUGUUUGGCUUUCAGUUAUAGUUUAAGAGCUAUGCUGGAAACAGCAUAGCAAGUUUAAAUAAGGCUAGUCCGUUAUCAACUUGAAAAAGUGGCACCGAGUCGGUGC | 510 |
| HBVg_121 | CUCCUCCUGCCUCCACCAAUGUUUAAGAGCUAUGCUGGAAACAGCAUAGCAAGUUUAAAUAAGGCUAGUCCGUUAUCAACUUGAAAAAGUGGCACCGAGUCGGUGC | 511 |
| HBVg_122 | GUCAUCCUCAGGCCAUGCAGGUUUAAGAGCUAUGCUGGAAACAGCAUAGCAAGUUUAAAUAAGGCUAGUCCGUUAUCAACUUGAAAAAGUGGCACCGAGUCGGUGC | 512 |
| HBVg_123 | CUGCCGUUCCGGCCGACCACGUUUAAGAGCUAUGCUGGAAACAGCAUAGCAAGUUUAAAUAAGGCUAGUCCGUUAUCAACUUGAAAAAGUGGCACCGAGUCGGUGC | 513 |
| HBVg_124 | CCUUCCUGACUGCCGAUUGGGUUUAAGAGCUAUGCUGGAAACAGCAUAGCAAGUUUAAAUAAGGCUAGUCCGUUAUCAACUUGAAAAAGUGGCACCGAGUCGGUGC | 514 |
| HBVg_125 | ACCUGCACGACUCCUGCUCAGUUUAAGAGCUAUGCUGGAAACAGCAUAGCAAGUUUAAAUAAGGCUAGUCCGUUAUCAACUUGAAAAAGUGGCACCGAGUCGGUGC | 515 |
| HBVg_126 | GGCCUGUAUUUUCCUGCUGGGUUUAAGAGCUAUGCUGGAAACAGCAUAGCAAGUUUAAAUAAGGCUAGUCCGUUAUCAACUUGAAAAAGUGGCACCGAGUCGGUGC | 516 |
| HBVg_127 | AACAUAGAGGUUCCUUGAGCGUUUAAGAGCUAUGCUGGAAACAGCAUAGCAAGUUUAAAUAAGGCUAGUCCGUUAUCAACUUGAAAAAGUGGCACCGAGUCGGUGC | 517 |

TABLE 6-continued

Gene-targeting gRNAs

| Sequence name | Gene-targeting gRNAs | SEQ ID |
|---|---|---|
| HBVg_128 | UGCCGUUCCGGCCGACCACGGUUUAAGAGCUAUGCUGGAAACAGCAUAGC AAGUUUAAAUAAGGCUAGUCCGUUAUCAACUUGAAAAAGUGGCACCGAGU CGGUGC | 518 |
| HBVg_129 | AUAGGCCAUCAGCGCAUGCGGUUUAAGAGCUAUGCUGGAAACAGCAUAGC AAGUUUAAAUAAGGCUAGUCCGUUAUCAACUUGAAAAAGUGGCACCGAGU CGGUGC | 519 |
| HBVg_130 | GCCUCCACCAAUCGGCAGUCGUUUAAGAGCUAUGCUGGAAACAGCAUAGC AAGUUUAAAUAAGGCUAGUCCGUUAUCAACUUGAAAAAGUGGCACCGAGU CGGUGC | 520 |
| HBVg_131 | GUCCUUUGUUUACGUCCCGUGUUUAAGAGCUAUGCUGGAAACAGCAUAGC AAGUUUAAAUAAGGCUAGUCCGUUAUCAACUUGAAAAAGUGGCACCGAGU CGGUGC | 521 |
| HBVg_132 | UGGGAACAAGAGCUACAGCAGUUUAAGAGCUAUGCUGGAAACAGCAUAGC AAGUUUAAAUAAGGCUAGUCCGUUAUCAACUUGAAAAAGUGGCACCGAGU CGGUGC | 522 |
| HBVg_133 | CUGUAAACAGGCCUAUUGAUGUUUAAGAGCUAUGCUGGAAACAGCAUAGC AAGUUUAAAUAAGGCUAGUCCGUUAUCAACUUGAAAAAGUGGCACCGAGU CGGUGC | 523 |
| HBVg_134 | GUCGCAGAAGAUCUCAAUCUGUUUAAGAGCUAUGCUGGAAACAGCAUAGC AAGUUUAAAUAAGGCUAGUCCGUUAUCAACUUGAAAAAGUGGCACCGAGU CGGUGC | 524 |
| HBVg_135 | CUGCCUUCCUGACUGCCGAUGUUUAAGAGCUAUGCUGGAAACAGCAUAGC AAGUUUAAAUAAGGCUAGUCCGUUAUCAACUUGAAAAAGUGGCACCGAGU CGGUGC | 525 |
| HBVg_136 | ACUACUAAUUCCCUGGAUGCGUUUAAGAGCUAUGCUGGAAACAGCAUAGC AAGUUUAAAUAAGGCUAGUCCGUUAUCAACUUGAAAAAGUGGCACCGAGU CGGUGC | 526 |
| HBVg_137 | CACAUUUCUUGCCUUACUUUGUUUAAGAGCUAUGCUGGAAACAGCAUAGC AAGUUUAAAUAAGGCUAGUCCGUUAUCAACUUGAAAAAGUGGCACCGAGU CGGUGC | 527 |
| HBVg_138 | GGAUGACUGUCUCUUAGAGGGUUUAAGAGCUAUGCUGGAAACAGCAUAGC AAGUUUAAAUAAGGCUAGUCCGUUAUCAACUUGAAAAAGUGGCACCGAGU CGGUGC | 528 |
| HBVg_139 | GCUAUGCCUCAUCUUCUUGUGUUUAAGAGCUAUGCUGGAAACAGCAUAGC AAGUUUAAAUAAGGCUAGUCCGUUAUCAACUUGAAAAAGUGGCACCGAGU CGGUGC | 529 |
| HBVg_140 | CCCGUCGGCGCUGAAUCCCGGUUUAAGAGCUAUGCUGGAAACAGCAUAGC AAGUUUAAAUAAGGCUAGUCCGUUAUCAACUUGAAAAAGUGGCACCGAGU CGGUGC | 530 |
| HBVg_141 | UAGUAUUCCUUGGACUCAUAGUUUAAGAGCUAUGCUGGAAACAGCAUAGC AAGUUUAAAUAAGGCUAGUCCGUUAUCAACUUGAAAAAGUGGCACCGAGU CGGUGC | 531 |
| HBVg_142 | AGGUAGGAGCGGGAGCAUUCGUUUAAGAGCUAUGCUGGAAACAGCAUAGC AAGUUUAAAUAAGGCUAGUCCGUUAUCAACUUGAAAAAGUGGCACCGAGU CGGUGC | 532 |
| HBVg_143 | UCUUUUGGGGUGGAGCCCUCGUUUAAGAGCUAUGCUGGAAACAGCAUAGC AAGUUUAAAUAAGGCUAGUCCGUUAUCAACUUGAAAAAGUGGCACCGAGU CGGUGC | 533 |
| HBVg_144 | UCAGUAUGCCCUGAGCCUGAGUUUAAGAGCUAUGCUGGAAACAGCAUAGC AAGUUUAAAUAAGGCUAGUCCGUUAUCAACUUGAAAAAGUGGCACCGAGU CGGUGC | 534 |
| HBVg_145 | UUUAAUGAGUGGGAGGAGUUGUUUAAGAGCUAUGCUGGAAACAGCAUAG CAAGUUUAAAUAAGGCUAGUCCGUUAUCAACUUGAAAAAGUGGCACCGAG UCGGUGC | 535 |

TABLE 6-continued

Gene-targeting gRNAs

| Sequence name | Gene-targeting gRNAs | SEQ ID |
|---|---|---|
| HBVg_146 | CUCCCUCGCCUCGCAGACGAGUUUAAGAGCUAUGCUGGAAACAGCAUAGC AAGUUUAAAUAAGGCUAGUCCGUUAUCAACUUGAAAAAGUGGCACCGAGU CGGUGC | 536 |
| HBVg_147 | GAUAAGAUAGGGGCAUUUGGGUUUAAGAGCUAUGCUGGAAACAGCAUAGC AAGUUUAAAUAAGGCUAGUCCGUUAUCAACUUGAAAAAGUGGCACCGAGU CGGUGC | 537 |
| HBVg_148 | CCGCGGGAUUCAGCGCCGACGUUUAAGAGCUAUGCUGGAAACAGCAUAGC AAGUUUAAAUAAGGCUAGUCCGUUAUCAACUUGAAAAAGUGGCACCGAGU CGGUGC | 538 |
| HBVg_149 | CAGCGAUAACCAGGACAAAUGUUUAAGAGCUAUGCUGGAAACAGCAUAGC AAGUUUAAAUAAGGCUAGUCCGUUAUCAACUUGAAAAAGUGGCACCGAGU CGGUGC | 539 |
| HBVg_150 | CAGGUAGGAGUGGGAGCAUUGUUUAAGAGCUAUGCUGGAAACAGCAUAGC AAGUUUAAAUAAGGCUAGUCCGUUAUCAACUUGAAAAAGUGGCACCGAGU CGGUGC | 540 |
| HBVg_151 | GUUUAAUGAGUGGGAGGAGUGUUUAAGAGCUAUGCUGGAAACAGCAUAG CAAGUUUAAAUAAGGCUAGUCCGUUAUCAACUUGAAAAAGUGGCACCGAG UCGGUGC | 541 |
| HBVg_152 | UGGUGAGUGAUUGGAGGUUGGUUUAAGAGCUAUGCUGGAAACAGCAUAG CAAGUUUAAAUAAGGCUAGUCCGUUAUCAACUUGAAAAAGUGGCACCGAG UCGGUGC | 542 |
| HBVg_153 | UAAUGAGUGGGAGGAGUUGGGUUUAAGAGCUAUGCUGGAAACAGCAUAG CAAGUUUAAAUAAGGCUAGUCCGUUAUCAACUUGAAAAAGUGGCACCGAG UCGGUGC | 543 |
| HBVg_154 | ACUACAUGUUCUGGAUAAUAGUUUAAGAGCUAUGCUGGAAACAGCAUAGC AAGUUUAAAUAAGGCUAGUCCGUUAUCAACUUGAAAAAGUGGCACCGAGU CGGUGC | 544 |
| HBVg_155 | GGCAUAGCAGCAGGAUGAAGGUUUAAGAGCUAUGCUGGAAACAGCAUAGC AAGUUUAAAUAAGGCUAGUCCGUUAUCAACUUGAAAAAGUGGCACCGAGU CGGUGC | 545 |
| HBVg_156 | GUUGAUAAGAUAGGGGCAUUGUUUAAGAGCUAUGCUGGAAACAGCAUAGC AAGUUUAAAUAAGGCUAGUCCGUUAUCAACUUGAAAAAGUGGCACCGAGU CGGUGC | 546 |
| HBVg_157 | UCAACGAAUUGUGGGUCUUUGUUUAAGAGCUAUGCUGGAAACAGCAUAGC AAGUUUAAAUAAGGCUAGUCCGUUAUCAACUUGAAAAAGUGGCACCGAGU CGGUGC | 547 |
| HBVg_158 | UAUGGAUGAUGUGGUAUUGGGUUUAAGAGCUAUGCUGGAAACAGCAUAG CAAGUUUAAAUAAGGCUAGUCCGUUAUCAACUUGAAAAAGUGGCACCGAG UCGGUGC | 548 |
| HBVg_159 | CAACGAAUUGUGGGUCUUUUGUUUAAGAGCUAUGCUGGAAACAGCAUAGC AAGUUUAAAUAAGGCUAGUCCGUUAUCAACUUGAAAAAGUGGCACCGAGU CGGUGC | 549 |
| HBVg_160 | CAUUUGUUCAGUGGUUCGUAGUUUAAGAGCUAUGCUGGAAACAGCAUAGC AAGUUUAAAUAAGGCUAGUCCGUUAUCAACUUGAAAAAGUGGCACCGAGU CGGUGC | 550 |
| HBVg_161 | CGUCUAACAACAGUAGUUUCGUUUAAGAGCUAUGCUGGAAACAGCAUAGC AAGUUUAAAUAAGGCUAGUCCGUUAUCAACUUGAAAAAGUGGCACCGAGU CGGUGC | 551 |
| HBVg_162 | UGCCUGAGUGCUGUAUGGUGGUUUAAGAGCUAUGCUGGAAACAGCAUAGC AAGUUUAAAUAAGGCUAGUCCGUUAUCAACUUGAAAAAGUGGCACCGAGU CGGUGC | 552 |
| HBVg_163 | GCCCCGAGACGGGUCGUCCGGUUUAAGAGCUAUGCUGGAAACAGCAUAGC AAGUUUAAAUAAGGCUAGUCCGUUAUCAACUUGAAAAAGUGGCACCGAGU CGGUGC | 553 |

TABLE 6-continued

Gene-targeting gRNAs

| Sequence name | Gene-targeting gRNAs | SEQ ID |
|---|---|---|
| HBVg_164 | GACUGCCGAUUGGUGGAGGCGUUUAAGAGCUAUGCUGGAAACAGCAUAGCAAGUUUAAAUAAGGCUAGUCCGUUAUCAACUUGAAAAAGUGGCACCGAGUCGGUGC | 554 |
| HBVg_165 | UAUAUGGAUGAUGUGGUAUUGUUUAAGAGCUAUGCUGGAAACAGCAUAGCAAGUUUAAAUAAGGCUAGUCCGUUAUCAACUUGAAAAAGUGGCACCGAGUCGGUGC | 555 |
| HBVg_166 | CUUGAGUAUUUGGUGUCUUUGUUUAAGAGCUAUGCUGGAAACAGCAUAGCAAGUUUAAAUAAGGCUAGUCCGUUAUCAACUUGAAAAAGUGGCACCGAGUCGGUGC | 556 |
| HBVg_167 | GAUCUGGUGGGCGUUCACGGGUUUAAGAGCUAUGCUGGAAACAGCAUAGCAAGUUUAAAUAAGGCUAGUCCGUUAUCAACUUGAAAAAGUGGCACCGAGUCGGUGC | 557 |
| HBVg_168 | AGACUGGGAGGAGUUGGGGGGUUUAAGAGCUAUGCUGGAAACAGCAUAGCAAGUUUAAAUAAGGCUAGUCCGUUAUCAACUUGAAAAAGUGGCACCGAGUCGGUGC | 558 |
| HBVg_169 | AGUCCUCUUAUGUAAGACCUGUUUAAGAGCUAUGCUGGAAACAGCAUAGCAAGUUUAAAUAAGGCUAGUCCGUUAUCAACUUGAAAAAGUGGCACCGAGUCGGUGC | 559 |
| HBVg_170 | CUCAAGAUGUUGUACAGACUGUUUAAGAGCUAUGCUGGAAACAGCAUAGCAAGUUUAAAUAAGGCUAGUCCGUUAUCAACUUGAAAAAGUGGCACCGAGUCGGUGC | 560 |
| HBVg_171 | GGGAACAAGAGCUACAGCAUGUUUAAGAGCUAUGCUGGAAACAGCAUAGCAAGUUUAAAUAAGGCUAGUCCGUUAUCAACUUGAAAAAGUGGCACCGAGUCGGUGC | 561 |
| HBVg_172 | UCGCAGAAGAUCUCAAUCUCGUUUAAGAGCUAUGCUGGAAACAGCAUAGCAAGUUUAAAUAAGGCUAGUCCGUUAUCAACUUGAAAAAGUGGCACCGAGUCGGUGC | 562 |
| HBVg_173 | GGGGUGGAGCCCUCAGGCUCGUUUAAGAGCUAUGCUGGAAACAGCAUAGCAAGUUUAAAUAAGGCUAGUCCGUUAUCAACUUGAAAAAGUGGCACCGAGUCGGUGC | 563 |
| HBVg_174 | UAUUCCUUGGACUCAUAAGGGUUUAAGAGCUAUGCUGGAAACAGCAUAGCAAGUUUAAAUAAGGCUAGUCCGUUAUCAACUUGAAAAAGUGGCACCGAGUCGGUGC | 564 |
| HBVg_175 | UCUAAGAGACAGUCAUCCUCGUUUAAGAGCUAUGCUGGAAACAGCAUAGCAAGUUUAAAUAAGGCUAGUCCGUUAUCAACUUGAAAAAGUGGCACCGAGUCGGUGC | 565 |
| HBVg_176 | CAACUCAAACAAUCCAGAUUGUUUAAGAGCUAUGCUGGAAACAGCAUAGCAAGUUUAAAUAAGGCUAGUCCGUUAUCAACUUGAAAAAGUGGCACCGAGUCGGUGC | 566 |
| HBVg_177 | AAACAAAGGACGUCCCGCGCGUUUAAGAGCUAUGCUGGAAACAGCAUAGCAAGUUUAAAUAAGGCUAGUCCGUUAUCAACUUGAAAAAGUGGCACCGAGUCGGUGC | 567 |
| HBVg_178 | CUGCCAACUGGAUCCUGCGCGUUUAAGAGCUAUGCUGGAAACAGCAUAGCAAGUUUAAAUAAGGCUAGUCCGUUAUCAACUUGAAAAAGUGGCACCGAGUCGGUGC | 568 |
| HBVg_179 | GAAGCUCCAAAUUCUUUAUAGUUUAAGAGCUAUGCUGGAAACAGCAUAGCAAGUUUAAAUAAGGCUAGUCCGUUAUCAACUUGAAAAAGUGGCACCGAGUCGGUGC | 569 |
| HBVg_180 | GUCAGUAUGCCCUGAGCCUGGUUUAAGAGCUAUGCUGGAAACAGCAUAGCAAGUUUAAAUAAGGCUAGUCCGUUAUCAACUUGAAAAAGUGGCACCGAGUCGGUGC | 570 |
| HBVg_181 | UUUCCCACCUUAUGAGUCCAGUUUAAGAGCUAUGCUGGAAACAGCAUAGCAAGUUUAAAUAAGGCUAGUCCGUUAUCAACUUGAAAAAGUGGCACCGAGUCGGUGC | 571 |

TABLE 6-continued

Gene-targeting gRNAs

| Sequence name | Gene-targeting gRNAs | SEQ ID |
|---|---|---|
| HBVg_182 | ACAAGAGGUUGGUGAGUGAUGUUUAAGAGCUAUGCUGGAAACAGCAUAGC AAGUUUAAAUAAGGCUAGUCCGUUAUCAACUUGAAAAAGUGGCACCGAGU CGGUGC | 572 |
| HBVg_183 | GAAAGCCCAAGAUGAUGGGAGUUUAAGAGCUAUGCUGGAAACAGCAUAGC AAGUUUAAAUAAGGCUAGUCCGUUAUCAACUUGAAAAAGUGGCACCGAGU CGGUGC | 573 |
| HBVg_184 | AGGUUCCACGCAUGCGCUGAGUUUAAGAGCUAUGCUGGAAACAGCAUAGC AAGUUUAAAUAAGGCUAGUCCGUUAUCAACUUGAAAAAGUGGCACCGAGU CGGUGC | 574 |
| HBVg_185 | UUGGUGAGUGAUUGGAGGUUGUUUAAGAGCUAUGCUGGAAACAGCAUAG CAAGUUUAAAUAAGGCUAGUCCGUUAUCAACUUGAAAAAGUGGCACCGAG UCGGUGC | 575 |
| HBVg_186 | AGAGCUACAGCAUGGGAGGUGUUUAAGAGCUAUGCUGGAAACAGCAUAGC AAGUUUAAAUAAGGCUAGUCCGUUAUCAACUUGAAAAAGUGGCACCGAGU CGGUGC | 576 |
| HBVg_187 | AUAUGGAUGAUGUGGUAUUGGUUUAAGAGCUAUGCUGGAAACAGCAUAG CAAGUUUAAAUAAGGCUAGUCCGUUAUCAACUUGAAAAAGUGGCACCGAG UCGGUGC | 577 |
| HBVg_188 | CCAUUUGUUCAGUGGUUCGUGUUUAAGAGCUAUGCUGGAAACAGCAUAGC AAGUUUAAAUAAGGCUAGUCCGUUAUCAACUUGAAAAAGUGGCACCGAGU CGGUGC | 578 |
| HBVg_189 | UUAUAUGGAUGAUGUGGUAUGUUUAAGAGCUAUGCUGGAAACAGCAUAG CAAGUUUAAAUAAGGCUAGUCCGUUAUCAACUUGAAAAAGUGGCACCGAG UCGGUGC | 579 |
| HBVg_190 | GGAGUGGGAGCAUUCGGGCCGUUUAAGAGCUAUGCUGGAAACAGCAUAGC AAGUUUAAAUAAGGCUAGUCCGUUAUCAACUUGAAAAAGUGGCACCGAGU CGGUGC | 580 |
| HBVg_191 | AUUUGGUGUCUUUUGGAGUGGUUUAAGAGCUAUGCUGGAAACAGCAUAGC AAGUUUAAAUAAGGCUAGUCCGUUAUCAACUUGAAAAAGUGGCACCGAGU CGGUGC | 581 |
| HBVg_192 | CACAGAAAGGCCUUGUAAGUGUUUAAGAGCUAUGCUGGAAACAGCAUAGC AAGUUUAAAUAAGGCUAGUCCGUUAUCAACUUGAAAAAGUGGCACCGAGU CGGUGC | 582 |
| HBVg_193 | ACCAAUUUUCUUUUGUCUUUGUUUAAGAGCUAUGCUGGAAACAGCAUAGC AAGUUUAAAUAAGGCUAGUCCGUUAUCAACUUGAAAAAGUGGCACCGAGU CGGUGC | 583 |
| HBVg_194 | AGGUUAAUGGUCUUUGUACUGUUUAAGAGCUAUGCUGGAAACAGCAUAGC AAGUUUAAAUAAGGCUAGUCCGUUAUCAACUUGAAAAAGUGGCACCGAGU CGGUGC | 584 |
| HBVg_195 | UACCAAUUUUCUUUUGUCUUGUUUAAGAGCUAUGCUGGAAACAGCAUAGC AAGUUUAAAUAAGGCUAGUCCGUUAUCAACUUGAAAAAGUGGCACCGAGU CGGUGC | 585 |

In some embodiments, a gRNA provided herein targets a target site in the Hepatitis B viral genome. In some embodiments, the gRNA targets a site positioned between 0-3300 bp of the HBV genome. In some embodiments, the gRNA targets a site positioned between 43 bp-490 bp, 1033 bp-1749 bp, 1800 bp-1950 bp, or 2953 bp-3182 of the HBV genome corresponding to positions with reference to the Hepatitis B Virus genome (Hepatitis B virus subtype ayw, complete genome, GenBank: U95551.1), SEQ ID NO: 650. In some embodiments, the gRNA targets a site positioned between 1 bp-42 bp, 491 bp-1032 bp, 1750 bp-1799 bp, or 1951 bp-2952 bp of the HBV genome corresponding to positions with reference to the Hepatitis B Virus genome (Hepatitis B virus subtype ayw, complete genome, Gen-Bank: U95551.1), SEQ ID NO: 650. In some embodiments, the gRNA targets a site at or near a regulatory element involved in HBV replication and/or transcription. In some embodiments, the gRNA targets polymerase gene, S-family gene, X-gene, or core family gene. In some embodiments, the gRNA targets the M/S-HBs, X, basal core, L-HBs promoter regions. In some embodiments, the gRNA targets Enh1 or an Enh2 enhancer region. In some embodiments, the gRNA targets an HBV coding region.

In some embodiments, a gRNA provided herein comprises the sequence selected from any one of SEQ ID NO: 196-229, a contiguous portion thereof of at least 14 nucleotides (e.g. 14, 15, 16, 17, 18 or 19 nucleotides), a complementary sequence of any of the foregoing, or a sequence having at or at least 80%, 85%, 90%, 91%, 92%, 93%, 94%, 95%, 96%, 97%, 98%, 99%, 99.5%, 99.9%, or 100% sequence identity to any of the foregoing. In some embodiments, the gRNA comprises a spacer sequence comprising the sequence selected from any one of SEQ ID NO:230-295, a contiguous portion thereof of at least 14 nt (e.g. 14, 15, 16, 17, 18 or 19 nucleotides), or a sequence having at or at least 80%, 85%, 90%, 91%, 92%, 93%, 94%, 95%, 96%, 97%, 98%, 99%, 99.5%, 99.9%, or 100% sequence identity to any of the foregoing. In some embodiments, the gRNA comprises a spacer sequence comprising the sequence selected from any one of SEQ ID NO:296-390, a contiguous portion thereof of at least 14 nt (e.g. 14, 15, 16, 17, 18 or 19 nucleotides), or a sequence having at or at least 80%, 85%, 90%, 91%, 92%, 93%, 94%, 95%, 96%, 97%, 98%, 99%, 99.5%, 99.9%, or 100% sequence identity to any of the foregoing. In some embodiments, the gRNA further comprises a scaffold sequence. In some embodiments, the scaffold sequence comprises the sequence set forth in SEQ ID NO:587, or a sequence having at or at least 80%, 85%, 90%, 91%, 92%, 93%, 94%, 95%, 96%, 97%, 98%, 99%, 99.5%, 99.9%, or 100% sequence identity to SEQ ID NO:587. In some embodiments, the gRNA, including a spacer sequence and a scaffold sequence, comprises the sequence selected from any one of SEQ ID NO:391-585, or a sequence having at or at least 80%, 85%, 90%, 91%, 92%, 93%, 94%, 95%, 96%, 97%, 98%, 99%, 99.5%, 99.9%, or 100% sequence identity to all or a portion thereof.

In some embodiments, the gRNA comprises a spacer sequence comprising the sequence selected from any one of SEQ ID NOS: 370, 333, 387, 347, 313, 320, 380, 256, 258, 311, 319, 230, 272, a contiguous portion thereof of at least 14 nucleotides (e.g. 14, 15, 16, 17, 18 or 19 nucleotides), a complementary sequence of any of the foregoing, or a sequence having at or at least 80%, 85%, 90%, 91%, 92%, 93%, 94%, 95%, 96%, 97%, 98%, 99%, 99.5%, 99.9%, or 100% sequence identity to any of the foregoing. In some embodiments, the gRNA further comprises a scaffold sequence. In some embodiments, the scaffold sequence comprises the sequence set forth in SEQ ID NO:587, or a sequence having at or at least 80%, 85%, 90%, 91%, 92%, 93%, 94%, 95%, 96%, 97%, 98%, 99%, 99.5%, 99.9%, or 100% sequence identity to SEQ ID NO:587. In some embodiments, the gRNA, including a spacer sequence and a scaffold sequence, comprises the sequence selected from any one of SEQ ID NOS: 565, 528, 542, 508, 515, 575, 515, 453, 506, 514, 425, or 472, or a sequence having at or at least 80%, 85%, 90%, 91%, 92%, 93%, 94%, 95%, 96%, 97%, 98%, 99%, 99.5%, 99.9%, or 100% sequence identity to all or a portion thereof. In some embodiments, the gRNA is set forth in SEQ ID NOS: 565, 528, 542, 508, 515, 575, 515, 453, 506, 514, 425, or 472.

In some embodiments, the gRNA comprises a spacer sequence comprising the sequence selected from any one of SEQ ID NOS: 200, 205, 207, 213, 217, 221, 224, 233, 251, 256, 257, 258, 263, 267, 274, 275, 277, 279, 293, 294, 311. 313, 316, 319, 320, 330, 333, 338, 345, 347, 353, 359, 370, 371, 377, 380, 384, 385, 387, a contiguous portion thereof of at least 14 nucleotides (e.g. 14, 15, 16, 17, 18 or 19 nucleotides), a complementary sequence of any of the foregoing, or a sequence having at or at least 80%, 85%, 90%, 91%, 92%, 93%, 94%, 95%, 96%, 97%, 98%, 99%, 99.5%, 99.9%, or 100% sequence identity to any of the foregoing. In some embodiments, the gRNA further comprises a scaffold sequence. In some embodiments, the scaffold sequence comprises the sequence set forth in SEQ ID NO:587, or a sequence having at or at least 80%, 85%, 90%, 91%, 92%, 93%, 94%, 95%, 96%, 97%, 98%, 99%, 99.5%, 99.9%, or 100% sequence identity to SEQ ID NO:587. In some embodiments, the gRNA, including a spacer sequence and a scaffold sequence, comprises the sequence selected from any one of SEQ ID NOS: 395, 400, 402, 408, 412, 416, 419, 428, 446, 451, 452, 453, 458, 462, 465, 469, 470, 472, 474, 488, 489, 506, 508, 511, 514, 515, 525, 528, 533, 540, 542, 548, 554, 565, 566, 572, 575, 579, 580, 582, or a sequence having at or at least 80%, 85%, 90%, 91%, 92%, 93%, 94%, 95%, 96%, 97%, 98%, 99%, 99.5%, 99.9%, or 100% sequence identity to all or a portion thereof.In some embodiments, the gRNA comprises a spacer sequence comprising the sequence selected from any one of SEQ ID NOS: 200, 201, 207, 217, 221, 224, 233, 237, 238, 246, 251, 256, 258, 263, 267, 274, 270, 277, 279, 283, 284, 293, 294, 308, 311, 313, 316, 319, 320, 325, 328, 330, 333, 338, 345, 347, 350, 353, 359, 360, 370, 371, 377, 380, 384, 385, 387, a contiguous portion thereof of at least 14 nucleotides (e.g. 14, 15, 16, 17, 18 or 19 nucleotides), a complementary sequence of any of the foregoing, or a sequence having at or at least 80%, 85%, 90%, 91%, 92%, 93%, 94%, 95%, 96%, 97%, 98%, 99%, 99.5%, 99.9%, or 100% sequence identity to any of the foregoing. In some embodiments, the gRNA further comprises a scaffold sequence. In some embodiments, the scaffold sequence comprises the sequence set forth in SEQ ID NO:587, or a sequence having at or at least 80%, 85%, 90%, 91%, 92%, 93%, 94%, 95%, 96%, 97%, 98%, 99%, 99.5%, 99.9%, or 100% sequence identity to SEQ ID NO:587. In some embodiments, the gRNA, including a spacer sequence and a scaffold sequence, comprises the sequence selected from any one of SEQ ID NOS: 369, 395, 402, 408, 412, 416, 419, 428, 432, 433, 441, 446, 451, 453, 458, 462, 465, 469, 472, 474, 478, 479, 488, 489, 503, 506, 508, 511, 514, 515, 520, 523, 525, 575, 528, 533, 540, 542, 545, 548, 554, 555, 565, 566, 572, 579, 580, 582, or a sequence having at or at least 80%, 85%, 90%, 91%, 92%, 93%, 94%, 95%, 96%, 97%, 98%, 99%, 99.5%, 99.9%, or 100% sequence identity to all or a portion thereof. In some embodiments, the gRNA is set forth in SEQ ID NOS: 369, 395, 402, 408, 412, 416, 419, 428, 432, 433, 441, 446, 451, 453, 458, 462, 465, 469, 472, 474, 478, 479, 488, 489, 503, 506, 508, 511, 514, 515, 520, 523, 525, 575, 528, 533, 540, 542, 545, 548, 554, 555, 565, 566, 572, 579, 580 or 582.

In some embodiments, the gRNA comprises a spacer sequence comprising the sequence selected from any one of SEQ ID NOS: 207, 213, 215, 217, 221, 222, 241, 245, 258, 261, 268, 274, 380, 387, a contiguous portion thereof of at least 14 nucleotides (e.g. 14, 15, 16, 17, 18 or 19 nucleotides), a complementary sequence of any of the foregoing, or a sequence having at or at least 80%, 85%, 90%, 91%, 92%, 93%, 94%, 95%, 96%, 97%, 98%, 99%, 99.5%, 99.9%, or 100% sequence identity to any of the foregoing. In some embodiments, the gRNA comprises a spacer sequence comprising the sequence SEQ ID NOS: 217, a contiguous portion thereof of at least 14 nucleotides (e.g. 14, 15, 16, 17, 18 or 19 nucleotides), a complementary sequence of any of the foregoing, or a sequence having at or at least 80%, 85%, 90%, 91%, 92%, 93%, 94%, 95%, 96%, 97%, 98%, 99%, 99.5%, 99.9%, or 100% sequence identity to SEQ ID NOS: 217. In some embodiments, the gRNA further comprises a scaffold sequence. In some embodiments, the scaffold sequence comprises the sequence set forth in SEQ ID NO:587, or a sequence having at or at least 80%, 85%, 90%, 91%, 92%, 93%, 94%, 95%, 96%, 97%, 98%, 99%, 99.5%, 99.9%, or 100% sequence identity to SEQ ID NO:587. In some embodiments, the gRNA, including a spacer sequence and a scaffold sequence, comprises the sequence selected from any one of SEQ ID NOS: 402, 408, 410, 412, 416, 417, 436, 440, 453, 456, 463, 469, 575, 582, or a sequence having at or at least 80%, 85%, 90%, 91%, 92%, 93%, 94%, 95%, 96%, 97%, 98%, 99%, 99.5%, 99.9%, or 100% sequence identity to all or a portion thereof. In some embodiments, a provided multiplexed epigenetic-modifying DNA-targeting system for epigenetic modification of at least two genes and/or regulatory elements thereof includes any of the aforementioned gRNAs complexed with a Cas protein, such as a Cas9 protein. In some embodiments, the Cas9 is a dCas9. In some embodiments, the dCas9 is a dSpCas9, such as a dSpCas9 set forth in SEQ ID NO: 599, or a variant and/or fusion thereof.

In some embodiments, provided herein is a combination of gRNAs. In some embodiments, provided herein is a multiplexed epigenetic-modifying DNA-targeting system comprising the combination of gRNAs.

In some embodiments, the combination of gRNAs comprises at least two gRNAs targeting at least two different genes or regulatory elements thereof. In some embodiments, the combination of gRNAs comprises a first gRNA targeted to a first gene or regulatory element thereof and a second gRNA targeted to a second gene or regulatory elements thereof. In some embodiments, the first gRNA targets a gene or regulatory elements thereof selected from the list consisting of polymerase gene, S-family gene, X-gene, core family gene, pre-S1 promoter, pre-S2 promoter, X promoter, basal core promoter, Enh1 enhancer, Enh2 enhancer, a transcript processing control region, and any coding region within the HBV genome, the second gRNA targets a gene or regulatory element thereof selected from the list consisting of polymerase gene, S-family gene, X-gene, core family gene, pre-S1 promoter, pre-S2 promoter, X promoter, basal core promoter, Enh1 enhancer, Enh2 enhancer, a transcript processing control region, and any coding region within the HBV genome, and the first and second gRNAs target different genes or regulatory elements thereof. In some embodiments, the first gRNA targets Enh1 enhancer, and the second gRNA targets a gene selected from the list consisting of L-HBs promoter, M-HBs promoter, S-HBs promoter, X-promoter, Basal core promoter, S-gene promoter, and Enh2 enhancer. In some embodiments, the first gRNA targets Enh1 enhancer, and the second gRNA targets L-HBs. In some embodiments, the first gRNA and second gRNA target a combination of two genes selected from the combinations of genes listed in Table 1. In some embodiments, the first gRNA and second gRNA are each independently selected from any of the gRNAs described herein.

In some embodiments, the combination of gRNAs comprises at least three gRNAs targeting at least three different genes or regulatory elements thereof. In some embodiments, the combination of gRNAs comprises a first gRNA targeted to a first gene, a second gRNA targeted to a second gene, and a third gRNA targeted to a third gene. In some embodiments, the combination of gRNAs comprises at least three gRNAs targeting at least three different genes or regulatory elements thereof. In some embodiments, the combination of gRNAs comprises a first gRNA targeted to a first gene or regulatory element thereof, a second gRNA targeted to a second gene or regulatory elements thereof, and a third gRNA targeted to a third gene or regulatory element thereof. In some embodiments, the first gRNA targets a gene or regulatory elements thereof selected from the list consisting of polymerase gene, S-family gene, X-gene, core family gene, pre-S1 promoter, pre-S2 promoter, X promoter, basal core promoter, Enh1 enhancer, Enh2 enhancer, a transcript processing control region, and any coding region within the HBV genome, the second gRNA targets a gene or regulatory element thereof selected from the list consisting of polymerase gene, S-family gene, X-gene, core family gene, pre-S1 promoter, pre-S2 promoter, X promoter, basal core promoter, Enh1 enhancer, Enh2 enhancer, a transcript processing control region, and any coding region within the HBV genome, the third gRNA targets a gene or regulatory elements thereof selected from the list consisting of polymerase gene, S-family gene, X-gene, core family gene, pre-S1 promoter, pre-S2 promoter, X promoter, basal core promoter, Enh1 enhancer, Enh2 enhancer, a transcript processing control region, and any coding region within the HBV genome, and the first, second, and third gRNAs target different genes or regulatory elements thereof. In some embodiments, the first gRNA targets Enh1 enhancer, the second gRNA targets a gene selected from the list consisting L-HBs promoter, M-HBs promoter, S-HBs promoter, X-promoter, Basal core promoter, S-gene promoter, Enh1 enhancer, and Enh2 enhancer, the third gRNA targets a gene selected from the list consisting of L-HBs promoter, M-HBs promoter, S-HBs promoter, X-promoter, Basal core promoter, S-gene promoter, Enh1 enhancer, and Enh2 enhancer and the second gRNA and third gRNA target different genes. In some embodiments, the first gRNA targets Enh1 enhancer, the second gRNA targets L-HBs promoter, and the third gRNA targets a gene selected from the list consisting of M-HBs promoter, S-HBs promoter, X-promoter, Basal core promoter, S-gene promoter, and Enh2 enhancer. In some embodiments, the first gRNA, second gRNA, and third gRNA target a combination of three genes selected from the combinations of genes listed in Table 2. In some embodiments, the first gRNA, second gRNA, and third gRNA are each independently selected from any of the gRNAs described herein.

In some embodiments, the combination of gRNAs comprises at least four gRNAs targeting at least four different genes or regulatory element thereof. In some embodiments, the combination of gRNAs comprises a first gRNA targeted to a first gene, a second gRNA targeted to a second gene, a third gRNA targeted to a third gene, and a fourth gRNA targeted to a fourth gene. In some embodiments, the combination of gRNAs comprises at least four gRNAs targeting at least four different genes or regulatory elements thereof. In some embodiments, the combination of gRNAs comprises a first gRNA targeted to a first gene or regulatory element thereof, a second gRNA targeted to a second gene or regulatory elements thereof, a third gRNA targeted to a third gene or regulatory element thereof, and a fourth gRNA targeted to a third gene or regulatory element thereof. In some embodiments, the first gRNA targets a gene or regulatory elements thereof selected from the list consisting of polymerase gene, S-family gene, X-gene, core family gene, pre-S1 promoter, pre-S2 promoter, X promoter, basal core promoter, Enh1 enhancer, Enh2 enhancer, a transcript processing control region, and any coding region within the HBV genome, the second gRNA targets a gene or regulatory element thereof selected from the list consisting of polymerase gene, S-family gene, X-gene, core family gene, pre-S1 promoter, pre-S2 promoter, X promoter, basal core promoter, Enh1 enhancer, Enh2 enhancer, a transcript processing control region, and any coding region within the HBV genome, the third gRNA targets a gene or regulatory elements thereof selected from the list consisting of polymerase gene, S-family gene, X-gene, core family gene, pre-S1 promoter, pre-S2 promoter, X promoter, basal core promoter, Enh1 enhancer, Enh2 enhancer, a transcript processing control region, and any coding region within the HBV genome, the fourth gRNA targets a gene or regulatory elements thereof selected from the list consisting of polymerase gene, S-family gene, X-gene, core family gene, pre-S1 promoter, pre-S2 promoter, X promoter, basal core promoter, Enh1 enhancer, Enh2 enhancer, a transcript processing control region, and any coding region within the HBV genome, and the first, second, third, and fourth gRNAs target different genes or regulatory elements thereof. In some embodiments, the first gRNA targets Enh1 enhancer, the second gRNA targets a gene selected from the list consisting L-HBs promoter, M-HBs promoter, S-HBs promoter, X-promoter, Basal core promoter, S-gene promoter, Enh1 enhancer, and Enh2 enhancer, the third gRNA targets a gene selected from the list consisting of L-HBs promoter, M-HBs promoter, S-HBs promoter, X-promoter, Basal core promoter, S-gene promoter, Enh1 enhancer, and Enh2 enhancer, the fourth gRNA targets a gene selected from the list consisting of L-HBs promoter, M-HBs promoter, S-HBs promoter, X-promoter, Basal core promoter, S-gene promoter, Enh1 enhancer, and Enh2 enhancer and the first, second, third, and fourth gRNAs target different genes or regulatory elements thereof. In some embodiments, the first gRNA, second gRNA, third gRNA, and fourth target a combination of four genes or regulatory elements thereof selected from the combinations of genes or regulatory elements thereof listed in Table 2. In some embodiments, the first gRNA, second gRNA, third gRNA, and fourth gRNA are each independently selected from any of the gRNAs described herein.

In some embodiments, the combination of gRNAs comprises at least five gRNAs targeting at least five different genes or regulatory element thereof. In some embodiments, the combination of gRNAs comprises at least six gRNAs targeting at least six different genes and/or regulatory element thereof. In some embodiments, the first, second, third, fourth, fifth, and/or sixth genes or regulatory elements thereof are different.

C. Engineered Zinc Finger Proteins (eZFPs)

In some aspects, provided herein are zinc finger proteins (ZFPs), such as engineered zinc finger proteins (eZFPs). In some embodiments, the eZFPs are capable of binding to, or bind to, a target site in an HBV gene or a regulatory element of a gene in the Hepatitis B Virus sequence. In some aspects, the eZFP can facilitate specific targeting of effector domains for transcriptional repression of a gene or a regulatory element. In some embodiments, provided herein are epigenetic-modifying DNA-targeting systems comprising fusion proteins comprising the eZFP and one or more other elements, such as the effector domains for transcriptional repression. Thus, in some aspects the eZFP facilitates decreased expression of an HBV gene or regulatory element, for example in connection with compositions and methods for treating a disease or disorder associated with HBV such as an HBV viral infection, liver disease, or cancer.

In some embodiments, a zinc finger protein (ZFP), a zinc finger DNA binding protein, or zinc finger DNA binding domain, is a protein, or a domain within a larger protein, that binds DNA in a sequence-specific manner through one or more zinc fingers, which are regions of amino acid sequence within the binding domain, having a structure that is stabilized through coordination of a zinc ion. Among the ZFPs are artificial, or engineered, ZFPs (eZFPs), comprising ZFP domains targeting specific DNA sequences, typically 9-18 nucleotides long, generated by assembly of individual zinc fingers. ZFPs include those in which a single finger domain is approximately 30 amino acids in length and contains an alpha helix containing two invariant histidine residues coordinated through zinc with two cysteines of a single beta turn, and having two, three, four, five, or six fingers. Generally, sequence-specificity of a ZFP may be altered by making amino acid substitutions at the four helix positions (−1, 2, 3, and 6) on a zinc finger recognition helix, also called a zinc finger recognition region. Thus, for example, a ZFP or ZFP-containing molecule, such as a fusion protein, can be non-naturally occurring, e.g., is engineered to bind to a target site of choice.

In some embodiments, zinc fingers can be custom-designed (i.e. designed by the user), and/or obtained from a commercial source. Various methods for designing zinc finger proteins are available. For example, methods for designing zinc finger proteins to bind to a target DNA sequence of interest are described, for example in Liu, Q. et al., PNAS, 94(11):5525-30 (1997); Wright, D. A. et al., Nat. Protoc., 1(3):1637-52 (2006); Gersbach, C. A. et al., Acc. Chem. Res., 47(8):2309-18 (2014); Bhakta M.S. et al., Methods Mol. Biol., 649:3-30 (2010); and Gaj et al., Trends Biotechnol, 31(7):397-405 (2013). In addition, various web-based tools for designing zinc finger proteins to bind to a DNA target sequence of interest are publicly available. See, for example, the Zinc Finger Tools design web site from Scripps available on the world wide web at scripps.edu/barbas/zfdesign/zfdesignhome.php. Various commercial services for designing zinc finger proteins to bind to a DNA target sequence of interest are also available. See, for example, the commercially available services or kits offered by Creative Biolabs (world wide web at creative-biolabs.com/Design-and-Synthesis-of-Artificial-Zinc-Finger-Proteins.html), the Zinc Finger Consortium Modular Assembly Kit available from Addgene (world wide web at addgene.org/kits/zfc-modular-assembly/), or the CompoZr Custom ZFN Service from Sigma Aldrich (world wide web at sigmaaldrich.com/life-science/zinc-finger-nuclease-technology/custom-zfn.html).

In some embodiments, provided herein are epigenetic-modifying DNA-targeting systems comprising fusion proteins comprising the eZFP and one or more other elements, such as the effector domains for transcriptional repression. In some embodiments, the at least one DNA-binding domain of the epigeneticmodifying DNA-targeting system comprises an engineered zinc finger protein (eZFP). In some embodiments, the epigenetic-modifying DNA-targeting system comprises an engineered zinc finger protein (eZFP) that binds to a target site in one or more HBV genes or regulatory elements thereof. The target site targeted by any of the provided eZFP can be any as described herein, such as any target site described in Section I.A.

In some embodiments, the target site for an eZFP (e.g., such as an eZFP comprised in a fusion protein of an epigenetic-modifying DNA-targeting system) provided herein is in one or more HBV genes or regulatory elements thereof. In some embodiments, the target site is in a CpG island (e.g., CpG island 1, CpG island 2, CpG island 3) of the HBV genome. In some embodiments, the target site is in CpG island 2 of the HBV genome. In some embodiments, the target site is within a target region spanning 1033 bp-1749 bp of the HBV genome corresponding to positions with reference to the HBV genome set forth in SEQ ID NO: 650. In some embodiments, the target site is within a target region spanning within 300 base pairs (bp), within 250 bp, within 200 bp, within 150 bp, within 140 bp, within 130 bp, within 120 bp, within 110 bp or within 100 bp upstreat of the HBx start codon. In some embodiments, the target site is within a target region sequence corresponding to the sequence spanning 1250-1374 bp with reference to the HBV genome set forth in SEQ ID NO: 650. In some embodiments, the target region has the sequence set forth in SEQ ID NO: 1068. In some embodiments, the target site is within a target region sequence corresponding to the sequence spanning 1255-1302 bp with reference to the HBV genome set forth in SEQ ID NO: 650. In some embodiments, the target region has the sequence set forth in SEQ ID NO: 1069. In some embodiments, the target site is within a target region sequence corresponding to the sequence spanning 1260-1300 bp with reference to the HBV genome set forth in SEQ ID NO: 650. In some embodiments, the target region has the sequence set forth in SEQ ID NO: 1070.

In some embodiments, the target site for an eZFP (e.g., such as an eZFP comprised in a fusion protein of an epigenetic-modifying DNA-targeting system) provided herein comprises the nucleotide sequence set forth in any one of SEQ ID NOS: 1028-1055 a contiguous portion thereof of at least 12 nt, or a complementary sequence of any of the foregoing. In some embodiments, the target site for an eZFP provided herein comprises the nucleotide sequence set forth in any one of SEQ ID NOS: 1028-1055. In some embodiments, the target site for an eZFP provided herein comprises the nucleotide sequence set forth in any one of SEQ ID NOS: 1045, 1046, or 1052, a contiguous portion thereof of at least 12 nt, or a complementary sequence of any of the foregoing. In some embodiments, the target site comprises the nucleotide sequence set forth in any one of SEQ ID NOS: 1045, 1046, or 1052.

In some embodiments, the target site is comprised in double-stranded DNA, such as HBV sequence integrated into human genomic DNA. In some embodiments, the target site is comprised in a covalently closed circular (cccDNA) HBV sequence. In some embodiments, the target site is comprised in a relaxed circular DNA (rcNDA) HBV sequence. In some embodiments, the eZFP is capable of binding to the target site. In some embodiments, the eZFP binds to the target site. In some embodiments, the binding is target-specific. For example, in some embodiments, an eZFP binds to the target site, and not to other sites comprising different sequences. For example, in some embodiments, an individual eZFP disclosed herein binds to the target site set forth in any one of SEQ ID NOS: 1028-1055, and does not bind to a different target site. in some embodiments, an individual eZFP disclosed herein binds to the target site set forth in any one of SEQ ID NOS: 1045, 1046, or 1052, and does not bind to a different target site. In some embodiments, the target site for an eZFP provided herein comprises a sequence set forth in Table 7.

TABLE 7 eZFP target sequences

| eZFP Target Site Sequence | SEQ ID NO: |
|---|---|
| CAAGTGTTTGCTGACGCA | 1028 |
| GGCTGGGGCTTGGTCATG | 1029 |
| GCTGGGGCTTGGTCATGG | 1030 |
| TTGGTCATGGGCCATCAG | 1031 |
| TGCGTGGAACCTTTTCGG | 1032 |
| GCAGCAGGTCTGGAGCAA | 1033 |
| CAGCAGGTCTGGAGCAAA | 1034 |
| AGCAGGTCTGGAGCAAAC | 1035 |

TABLE 7-continued eZFP target sequences

| eZFP Target Site Sequence | SEQ ID NO: |
|---|---|
| ATCGTATCCATGGCTGCT | 1036 |
| CCAGTGGGGGTTGCGTCA | 1037 |
| CCCCAGCCAGTGGGGGTT | 1038 |
| GCGCTGATGGCCCATGAC | 1039 |
| CACGCACGCGCTGATGGC | 1040 |
| AGAGGAGCCGAAAAGGTT | 1041 |
| GGATCGGCAGAGGAGCCG | 1042 |
| CAGTATGGATCGGCAGAG | 1043 |
| GTTCCGCAGTATGGATCG | 1044 |
| GGAGTTCCGCAGTATGGA | 1045 |
| GCAAACAAGCGGCTAGG | 1046 |
| TTTGCTCCAGACCTGCTG | 1047 |
| GATGTATATTTGCGGGAG | 1048 |
| CAGCCAGTGGGGGTTGCG | 1049 |
| GATGGCCCATGACCAAGC | 1050 |
| GGGGTAAAGGTTCAGGTA | 1051 |
| GCTAGGAGTTCCGCAGTA | 1052 |
| GCGGCTAGGAGTTCCGCA | 1053 |
| GTATGGATCGGCAGAGGA | 1054 |
| CCGATCCATACTGCGGAA | 1055 |

In some embodiments, the target site for an eZFP provided herein (e.g., such as an eZFP comprised in a fusion protein of an epigenetic-modifying DNA-targeting system) comprises the nucleotide sequence set forth in SEQ ID NO: 1045. In some embodiments, a contiguous portion thereof of at least 12 nt, or a complementary sequence of any of the foregoing. In some embodiments, the target site for an eZFP provided herein comprises the sequence set forth in SEQ ID NO:1045.

In some embodiments, the target site for an eZFP provided herein (e.g., such as an eZFP comprised in a fusion protein of an epigenetic-modifying DNA-targeting system) comprises the nucleotide sequence set forth in SEQ ID NO: 1046. In some embodiments, a contiguous portion thereof of at least 12 nt, or a complementary sequence of any of the foregoing. In some embodiments, the target site for an eZFP provided herein comprises the sequence set forth in SEQ ID NO:1046.

In some embodiments, the target site for an eZFP provided herein (e.g., such as an eZFP comprised in a fusion protein of an epigenetic-modifying DNA-targeting system) comprises the nucleotide sequence set forth in SEQ ID NO: 1052. In some embodiments, a contiguous portion thereof of at least 12 nt, or a complementary sequence of any of the foregoing. In some embodiments, the target site for an eZFP provided herein comprises the sequence set forth in SEQ ID NO:1052.

In some embodiments, the eZFP comprises multiple zinc fingers. In some embodiments, each zinc finger comprises a recognition region. In some embodiments, the recognition regions together facilitate sequence-specific binding of the eZFP, for example to a specific target site. In some embodiments, the eZFP comprises six zinc fingers denoted F1 through F6 in order from N-terminus to C-terminus, each comprising a corresponding recognition region F1 through F6, which facilitate sequence-specific binding to a specific target site.

In some embodiments, characteristics of eZFPs targeting specific target sites provided herein are shown in Table E4.

In some embodiments, the eZFP comprises six zinc fingers denoted F1 through F6 in order from N-terminus to C-terminus, each comprising a corresponding recognition region 11-1F6, as shown in Table E4. In some embodiments, the recognition regions F1-F6 facilitate specific binding to the indicated target site sequence in Table E4. In some embodiments, the eZFP comprises an amino acid sequence comprising the recognition regions, as shown in Table E4. In some embodiments, the eZFP can be encoded by a DNA sequence as shown in Table 8.

TABLE 8 eZFP DNA sequences

| SEQ ID NOs | Sequence | Description |
|---|---|---|
| 888 | GCTGCTATGGCAGAGCGGCCATTTCAGTGTCGAATTTGCATGCGAAATTTCTCTAGCG AAGCGGATCGAAGTAGACATATCCGGACCCATACGGGTGAGAAACCGTTCGCGTGTG ATATATGCGGTCGCAAATTCGCAGACCGCTCCAACCTGACAAGGCACACAAAAATTCA TACTGGAAGCCAGAAACCGTTTCAGTGCCGGATTTGTATGCGCAATTTCTCTCAATCCT CCGATCTCTCCCGCCACATCAGGACTCATACCGGGGAGAAACCCTTTGCTTGTGACAT TTGTGGCAGAAAGTTTGCCTATCACTGGTACCTTAAGAAGCACACCAAGATCCATACT GGCTCTCAAAAGCCTTTCCAATGCCGAATATGTATGCGAAACTTTTCTAGGTCTGACTC CCTCTCTGTACATATCCGCACTCACACGGGTGAAAAACCATTTGCCTGTGACATATGT GGCAGAAAATTTGCTCAAAATGCGAACCGAAAAACGCATACGAAAATCCATTTGCGA CAAAAAGATGCAGCTCGG | ZFP DNA sequence |
| 889 | GCGGCAATGGCAGAACGCCCGTTTCAGTGTAGAATCTGCATGCGCAATTTCTCCAGAA GTGACGTACTCAGCACGCATATCAGAACACATACTGGTGAAAAACCGTTTGCTTGTGA TATCTGTGGTAAGAAATTCGCGGATAACTCCTCAAGGACGCGGCATACGAAGATCCAC ACTGGTTCTCAAAAGCCGTTCCAGTGCCGGATATGCATGCGGAACTTTAGTCGGCCAT ATACGCTTCGACTTCATATTAGGACTCACACCGGCGAAAAGCCGTTCGCCTGTGACAT TTGCGGGAGAAAATTCGCTGACTCTAGTCACCGCACGAGGCACACTAAAATACATACT GGTTCACAAAAACCATTCCAGTGCCGAATTTGCATGCGAAATTTTTCCCGAAGTGACC ATCTCTCACAGCACATCCGCACCCATACAGGGGAGAAGCCCTTCGCTTGTGATATATG CGGACGCAAGTTCGCGGACAGCTCACACCGGACCCGCCATACAAAGATCCACTTGAG ACAGAAAGATGCAGCGCGG | ZFP DNA sequence |
| 890 | GCCGCAATGGCCGAAAGACCATTTCAGTGCAGGATATGTATGCGCAACTTCTCTCGCA GTGACCACCTGAGTCAACATATCAGGACACACACGGGTGAAAAGCCTTTTGCATGCGA TATTTGTGGTCGAAAATTTGCTCAGTCTGCGGACCGAACCAAGCACACTAAAATTCAT ACCGGCTCACAGAAACCGTTTCAATGCCGCATCTGTATGAGGAATTTCTCTAGATCAG ACCACTTGTCCAACACATCCGGACTCATACTGGAGAAAAGCCGTTTGCATGTGACAT TTGTGGCAGGAAGTTTGCTAGAAGGTCTGACCTTAAAAGGCACACAAAATTCATACG GGTTCCCAGAAACCATTTCAGTGCCGGATATGCATGCGGAACTTTTCACGAAGCGACC ACCTCTCCCGACATATTCGAACGCACACTGGTGAGAAGCCGTTTGCTTGCGACATTTG CGGACGCAAGTTCGCTCAGAGCTCCGACTTGAGGAGGCATACCAAGATTCATCTCCGG CAGAAAGATGCCGCGCGG | ZFP DNA sequence |
| 891 | GCCGCGATGGCTGAGAGACCATTTCAGTGTCGAATCTGCATGAGAAATTTTTCAAGGA GTGACAATCTGTCTGAGCACATACGAACACATACTGGGGAAAAACCCTTTGCATGTGA CATTTGTGGAAGAAAGTTTGCTACCAGCTCAAATCGCAAAACACATACAAAGATACAT ACCGGCTCCCAAAAGCCATTCCAGTGCCGCATCTGCATGAGGAACTTTTCCGATCGCT CACATCTTACCCGCCACATAAGAACTCACACAGGCGAAAAGCCCTTTGCCTGCGATAT ATGCGGACGGAAGTTCGCCCGCTCCGACGCTTTGACCCAGCATACCAAAATCCATACT GGGTCTCAAAAGCCATTTCAGTGCCGAATCTGTATGAGGAATTTCTCCGACAGGTCAG CATTGGCACGGCATATCCGCACCCATACCGGTGAGAAGCCTTTTGCTTGCGATATCTG TGGACGAAAATTTGCCCGGAGGTTCACTCTCTCCAAACACACAAAGATACATCTGCGC CAAAAGGATGCAGCCCGG | ZFP DNA sequence |
| 892 | GCCGCAATGGCTGAGCGCCCGTTCCAGTGCAGAATATGCATGCGGAATTTTTCTAGGT CAGATCATTTGTCTGAGCATATTCGCACACACACGGGAGAGAAGCCCTTTGCTTGCGA TATATGTGGAAGGAAATTCGCGCAATACAGTGGGCGCTACTACCATACAAAGATCCAT ACGGGCTCCCAGAAGCCCTTCCAATGTCGAATATGTATGAGGAATTTTAGTCACGGAC AAACATTGAATGAACATATACGCACTCACACTGGTGAAAAACCATTTGCGTGCGATAT TTGCGGAAGGAAGTTTGCTCAGTCTGGGAATTTGGCGCGACACACCAAGATCCACACA GGATCCCAGAAACCATTTCAGTGCAGAATTTGTATGAGAAACTTTAGCCGCAGTGACA GTCTCTTGAGGCACATACGGACTCATACTGGGGAGAAACCATTCGCCTGCGATATTTG TGGACGAAAGTTCGCCTGTCGCGAGTACAGAGGCAAGCACACTAAGATACATCTTAG GCAAAAGGACGCTGCACGG | ZFP DNA sequence |
| 893 | GCCGCGATGGCTGAGAGGCCTTTTCAATGTCGAATCTGTATGAGGAACTTCTCTCAAT CTGCTAATCGCACGACGCACATTCGAACGCATACCGGTGAGAAGCCATTCGCGTGCGA TATCTGCGGACGGAAATTCGCGAGGTCAGCTAATCTTACACGGCACACGAAGATCCAC ACAGGGTCACAGAAACCTTTTCAGTGTCGCATTTGCATGAGGAATTTCTCCCGATCTG ACGTCCTTAGCGAACATATACGAACTCACACGGGCGAGAAGCCATTTGCGTGCGATAT ATGCGGGAGGAAGTTTGCCACCTCTGGACATCTGAGTCGACATACCAAAATTCATACC | ZFP DNA sequence |

TABLE 8-continued eZFP DNA sequences

| SEQ ID NOs | Sequence | Description |
|---|---|---|
| | GGTAGTCAGAAGCCGTTCCAATGCAGAATATGTATGCGAAATTTCTCTCAAAGCTCAG<br>ACTTGTCTAGGCACATAAGAACGCACACGGGTGAAAAACCTTTCGCGTGTGATATCTG<br>CGGCAGAAAGTTCGCACAATGGTCCACCCGAAAGCGGCATACGAAGATTCACCTCAG<br>ACAGAAAGACGCTGCCCGG | |
| 894 | GCGGCGATGGCAGAACGCCCGTTCCAATGCAGAATATGTATGAGAAACTTCTCCCAGA<br>GCGGAAATCTGGCACGCCACATCCGGACACACACGGGAGAGAAGCCATTTGCTTGTG<br>ACATTTGTGGTCGCAAATTTGCCGCCACCTGTTGTCTGGCACATCATACTAAGATACAT<br>ACGGGGTCACAGAAACCATTCCAATGTAGGATCTGCATGCGGAATTTTTCTCGGTGGC<br>AGTATTTGCCTACGCATATTAGAACCCACGCCGGTGAGAAACCGTTTGCATGTGACAT<br>CTGCGGACGAAAGTTTGCCGATAGATCTGCGCTTGCTAGGCATACTAAAATCCACACG<br>GGGTCCCAGAAGCCTTTTCAGTGTCGGATATGTATGAGGAACTTCAGTCGATCAGACA<br>ACCTTAGCGAGCATATTCGGACGCATACTGGAGAAAAACCTTTTGCTTGTGATATATG<br>CGGTAGGAAGTTCGCCAAACGGTGTAACCTTCGCTGTCACACCAAAATACATCTTCGC<br>CAGAAAGATGCGGCCCGG | ZFP DNA sequence |
| 895 | GCCGCTATGGCTGAAAGACCATTCCAGTGCAGAATATGTATGAGGAATTTTTCTAATC<br>CCGCGAACCTTACGCGCCATATCAGGACGCACACGGGCGAAAAGCCCTTCGCCTGCG<br>ACATTTGTGGGAGAAGTTTGCTCAAAACGCGACCAGGACAGGACACACGAAAATTC<br>ACACTGGTAGCCAGAAGCCGTTCCAGTGTAGGATCTGTATGCGCAATTTCTCTCAGTC<br>CGGGCACCTCGCGCGACACATAAGAACTCATACGGGGAGAAGCCGTTTGCATGTGA<br>CATCTGCGGCCGCAAGTTTGCGAATAGGCATGACAGGGCAAAACATACGAAGATCCA<br>TACAGGTTCTCAAAAACCTTTCCAATGTCGAATATGCATGCGCAACTTTAGTCGGTCA<br>GACCACCTTTCTGAACACATCAGGACACACACTGGCGAAAAGCCGTTCGCATGTGACA<br>TTTGCGGCAGAAAGTTCGCACAAAGACGGTCCCGCTATAAGCACACCAAAATTCACCT<br>TAGGCAAAAGGATGCAGCTCGG | ZFP DNA sequence |
| 896 | GCGGCAATGGCAGAACGACCCTTCCAATGCCGCATATGTATGCGAAACTTCAGCCAGA<br>GCTCAGATCTTTCCAGACACATCAGGACTCACACTGGCGAAAAACCATTTGCATGCGA<br>TATATGCGGGAGAAAATTCGCGCACCGCAGTACGCGAAACAGGCATACAAAGATACA<br>TACTGGCAGTCAAAAGCCATTTCAATGTCGAATATGCATGAGGAACTTTAGTCGATCT<br>GACGTGCTGAGCGCTCACATACGGACCCATACCGGAGAGAAACCATTCGCTTGTGACA<br>TCTGTGGTAGGAAGTTCGCGGATTCCCGGACCCGCAAAAATCATACTAAAATTCACAC<br>TGGGTCTCAGAAGCCCTTTCAGTGTAGGATATGTATGCGCAATTTTAGCCAGAGTGGT<br>TCATTGACTCGGCATATCAGAACACATACTGGAGAGAAACCTTTCGCGTGTGATATTT<br>GCGGTCGAAAGTTCGCAGATCAGAGTGGACTTGCGCACCATACTAAGATCCACCTGAG<br>ACAGAAGGACGCTGCGCGG | ZFP DNA sequence |
| 897 | GCTGCCATGGCGGAGCGCCCTTTCCAGTGTAGGATATGTATGCGCAACTTCAGTCAGA<br>ACCCAGCCCAGTGGCGGCACATACGGACGCATACTGGAGAGAAGCCATTTGCATGTG<br>ATATCTGCGGGCGAAAATTCGCGCGGTCAGCAGATTTGAGCCGGCATACGAAGATCC<br>ATACAGGTTCACAAAAGCCATTTCAATGTCGGATATGTATGCGGAACTTCAGCACGTC<br>CGGCTCATTGTCAAGACATATACGAACTCATACCGGAGAGAAACCCTTCGCGTGCGAC<br>ATTTGCGGTCGGAAGTTCGCGCGATCCGACCATCTGTCACGACATACGAAAATACACA<br>CTGGCTCTCAAAAGCCGTTTCAGTGCAGAATTTGCATGAGAAATTTTAGCAGGAGCGA<br>CTCACTCCTTCGGCATATACGAACACACACTGGTGAGAAGCCATTTGCCTGTGATATTT<br>GTGGACGAAAGTTTGCGCAATCTTACGATAGGTTTCAGCATACAAAAATCCACCTTCG<br>GCAAAAGGACGCGGCACGG | ZFP DNA sequence |
| 898 | GCTGCCATGGCTGAACGACCGTTTCAATGTCGAATTTGCATGCGCAACTTCTCCACGTC<br>CGGGTCTCTCAGTAGACACATCAGAACGCATACTGGTGAAAAACCATTCGCTTGTGAC<br>ATATGCGGCCGAAAATTCGCGCGGAGCGACCACCTGTCACGGCATACCAAAATTCAC<br>ACCGGGAGTCAAAAACCGTTCCAGTGTAGGATATGTATGCGCAACTTCAGCCGGTCTG<br>ACAGTCTGCTTCGACATATTCGGACGCACACTGGTGAAAAGCCGTTTGCGTGCGACAT<br>TTGTGGTCGAAAGTTCGCTCAATCTTATGATAGGTTTCAACACACCAAAATACATACG<br>GGCTCCCAGAAGCCGTTCCAGTGCAGAATATGCATGAGAAATTTCTCTCGCAGTGACA<br>ATTTGTCCACCCATATTCGAACGCACACCGGCGAGAAACCCTTCGCCTGCGATATTTG<br>CGGTCGCAAGTTCGCAGACAACAGGGATAGGATAAAACATACGAAGATCCATCTGAG<br>GCAAAAGACGCCGCCCGG | ZFP DNA sequence |
| 899 | GCAGCCATGGCAGAGCGGCCATTCCAGTGCAGAATCTGCATGCGGAACTTTTCCGATA<br>GGTCCAATCTGTCACGCCATATTAGGACACACACGGGTGAAAAACCGTTCGCGTGTGA<br>CATATGCGGTCGCAAATTCGCCCTGAGACAGAACCTGATTATGCACACAAAATACAT<br>ACGGGAAGCCAGAAACCGTTCCAGTGTCGGATATGCATGAGGAACTTCAGTGAGAGG<br>GGGACTTTGGCGAGGCACATCAGGACTCACACTGGGGAGAAGCCCTTTGCATGTGATA<br>TCTGTGGCCGAAAATTTGCTCGATCAGATGCTCTCACCCAACATACAAAGATCCATAC<br>TGGCTCTCAAAAACCGTTTCAATGTAGAATTTGTATGCGCAACTTCTCTCGGTCAGATA<br>GCCTGTCCCAGCATATCCGAACTCATACAGGTGAGAAACCCTTCGCATGCGACATCTG<br>TGGGCGAAAATTGCTAGAAAAGCAGACCGGACCCGACACACAAAGATTCATCTGCG<br>ACAAAAAGACGCCGCCGG | ZFP DNA sequence |
| 900 | GCGGCCATGGCTGAGAGGCCTTTTCAATGTAGAATATGTATGCGAAATTTTTCACAGT<br>ACTGTTGTCTCACGAACCACATAAGGACTCATACAGGGGAGAAACCATTTGCCTGTGA<br>CATTTGCGGTCGCAAATTTGCTACTTCTGGAAACCTGACTCGGCACACTAAGATTCAC | ZFP DNA sequence |

TABLE 8-continued eZFP DNA sequences

| SEQ ID NOs | Sequence | Description |
|---|---|---|
|  | ACAGGGTCCCAGAAGCCCTTCCAGTGTCGCATTTGCATGAGGAATTTTAGTCAAAGCT<br>CTGACTTGTCAAGGCATATTCGCACGCACACGGGCGAAAAGCCGTTCGCTTGCGACAT<br>ATGCGGGCGGAAATTTGCCTTCCGCTATTATTTGAAGAGACACACCAAGATACATACG<br>GGCTCTCAGAAGCCCTTTCAGTGTAGGATTTGCATGCGCAATTTTTCACAATCGGTGA<br>TCTCACGCGACACATCCGGACTCACACAGGTGAAAAGCCTTTCGCGTGCGACATTTGC<br>GGCCGGAAGTTTGCTGACAAGGGCAACCTCACAAAGCATACGAAGATTCACTTGAGG<br>CAGAAAGATGCTGCTCGG |  |
| 901 | GCCGCCATGGCCGAACGACCATTCCAGTGCAGGATATGTATGCGCAATTTTTCAACCA<br>GTGGTTCATTGTCACGACATATTAGAACACACACCGGTGAGAAACCCTTTGCGTGTGA<br>CATCTGTGGGAGGAAATTTCGCAAGATCTGACAACCTTACGACACATACAAAGATTCAC<br>ACAGGCTCTCAAAAGCCCTTCCAGTGCCGAATTTGCATGCGAAACTTTTCCCAGTCTG<br>GTAATCTCGCTCGACATATCAGAACCCACACGGGGGAAAAACCATTCGCTTGTGATAT<br>TTGCGGACGAAAGTTCGCCGACAGAACCACACTCATGAGACACACTAAAATCCATACT<br>GGTAGTCAGAAGCCGTTTCAGTGTAGAATCTGCATGAGGAACTTTTCCCAGTCAGGCC<br>ACCTTGCAAGACATATACGAACTCACACTGGAGAAAAGCCGTTCGCCTGTGACATTTG<br>TGGGCGCAAGTTCGCGCAACTCACCCATCGAATAGCCATACGAAGATTCACTTGAGA<br>CAGAAAGATGCGGCTCGG | ZFP DNA sequence |
| 902 | GCAGCTATGGCTGAACGCCCATTCCAGTGTCGGATCTGCATGCGCAACTTTTCTATAA<br>AACACGATCTTCACCGACACATTCGGACACATACTGGGGAGAAGCCCTTTGCGTGTGA<br>CATCTGTGGCCGAAAGTTCGCTAGATCCGCAAACTTGACTCGGCATACAGAAAATTCAC<br>ACTGGAAGCCAGAAACCTTTCCAATGTCGAATCTGTATGAGGAACTTTAGCAGAAGTG<br>ATAATCTCGCCAGGCATATCCGAACGCACACAGGCGAGAAGCCATTCGCATGTGATAT<br>TTGTGGTAGAAAGTTCGCCCAAAATGTCTCTCGCCCACGCCATACTAAGATCCACACG<br>GGCTCCCAGAAGCCGTTCCAATGCCGCATTTGCATGCGAAACTTTTCCAGATCAGACG<br>ATCTGAGCAAGCATATTAGGACGCATACAGGGGAGAAGCCTTTTGCTTGCGACATTTG<br>CGGCCGGAAATTTGCTGACTCAAGTCACAGAACACGGCATACCAAGATACACCTTCGA<br>CAAAAAGATGCCGCACGG | ZFP DNA sequence |
| 903 | GCGGCCATGGCGGAACGACCCTTTCAGTGCCGAATTTGCATGAGGAACTTTTCACGAT<br>CTGATAACCTGGCGAGGCACATCCGAACACATACGGGCGAGAAGCCATTCGCATGTG<br>ATATCTGCGGGCGAAAGTTCGCCCAAAATGTCAGTAGACCGCGACATACTAAAATAC<br>ACACTGGCTCACAGAAGCCGTTCCAATGCCGCATCTGTATGCGCAATTTTTCCCGAAG<br>CGACGATCTGTCTAAACATATTCGGACGCACACTGGGGAAAAGCCTTTCGCTTGTGAC<br>ATCTGTGGGAGGAAGTTCGCTGACAGCTCTCATAGGACACGCCATACTAAGATTCATA<br>CCGGAAGCCAGAAGCCTTTCCAGTGTCGGATTTGCATGAGAAACTTTAGCACTTCTAG<br>CAACAGAAAGACACATATACGAACCCATACGGGTGAGAAACCGTTCGCATGCGATAT<br>CTGTGGGCGAAAATTTGCAGCCCAATGGACCAGAGCTTGCCATACCAAGATACACCTT<br>CGGCAGAAGGACGCTGCACGG | ZFP DNA sequence |
| 904 | GCTGCGATGGCAGAACGACCTTTTCAATGCCGAATTTGTATGAGGAACTTTTCCCGGT<br>CAGACGACCTTTCCAAGCACATCAGAACTCATACCGGAGAAAAACCGTTCGCCTGTGA<br>CATTTGTGGACGGAAGTTTGCTGACTCCTCTCACAGGACTCGCCACACTAAGATACAC<br>ACCGGAAGTCAGAAGCCCTTCCAATGTAGGATATGCATGAGAAACTTCAGTACGTCAT<br>CAAACCGAAAACGCATATCAGGACACATACCGGCGAAAAGCCGTTTGCATGTGATA<br>TCTGCGGCAGGAAATTTGCAGCTCAGTGGACACGGGCATGTCACACAAAAATCCATAC<br>CGGTAGTCAAAAACCGTTTCAGTGTCGAATCTGCATGAGGAACTTTAGCCGGAAGCAG<br>ACGAGAACCACGCATATAAGAACTCACACAGGTGAGAAACCCTTTGCGTGCGATATCT<br>GCGGTCGCAAATTTGCTCACCGATCCTCCCTGAGGCGACATACTAAAATACATCTGCG<br>ACAGAAAGACGCGGCTCGG | ZFP DNA sequence |
| 905 | GCCGCCATGGCAGAACGGCCTTTTCAGTGTCGGATCTGCATGAGAAACTTTAGTCAGA<br>GTGCCCATCGCAAGAATCATATTCGAACTCATACCGGTGAAAAACCGTTCGCGTGCGA<br>CATCTGTGGTCGAAAGTTTGCCACATCATCCAATAGAAAAACGCATACTAAGATTCAT<br>ACCGGTAGCCAGAAACCATTCCAATGTAGAATCTGCATGCGAAATTTCAGCAGGAGTG<br>ACAATTTGTCCGCACATATACGGACACACACGGGCGAAAAACCCTTTGCTTGCGATAT<br>ATGCGGTAGAAAGTTCGCTAGGAACAACGACCGAAAAACACACGAAGATTCATAC<br>AGGTAGTCAGAAGCCATTTCAATGTCGGATCTGTATGCGAAATTTCTCTACTTCTGGCA<br>GCCTGTCCCGGCACATCAGAACACATACCGGTGAGAAGCCATTTGCATGTGACATATG<br>TGGGAGAAAATTTGCCCAGGCGGGTCACCTTGCGAAGCATACAAAGATCCACCTCCGC<br>CAGAAGGACGCCGCACGG | ZFP DNA sequence |
| 906 | GCGGCTATGGCAGAGCGGCCATTCCAATGTAGGATATGTATGAGGAACTTCTCCCGGA<br>GCGATCACCTGTCCCAACACATCCGCACGCATACGGGTGAGAAGCCGTTTGCTTGTGA<br>TATCTGCGGAAGAAAATTTGCAGCATCCAGTACACGCACAAAGCATACGAAGATTCAT<br>ACGGGATCCCAAAAGCCCTTTCAATGCAGGATTTGTATGAGGAACTTCAGTCGGTCCG<br>ACGATCTGACACGACATATTAGAACTCATACTGGAGAAGCCATTCGCATGTGACAT<br>CTGCGGTAGGAAGTTCGCGCAGAAATCTAACCTGTCATCTCACACCAAGATACATACA<br>GGCTCACAGAAGCCGTTTCAATGCCGCATCTGCATGAGGAATTTCAGCCAGTCCGCAA<br>ACAGAACTACGCATATTCGGACGCATACCGGCGAGAAGCCGTTTGCCTGCGACATTTG<br>CGGGAGGAAATTCGCACAGAACGCGACCAGAACCCAAACACACCAAAATCCATCTTAG<br>GCAAAAGGATGCGGCCCGG | ZFP DNA sequence |

TABLE 8-continued eZFP DNA sequences

| SEQ ID NOs | Sequence | Description |
|---|---|---|
| 907 | GCGGCCATGGCAGAACGACCCTTTCAGTGCCGAATTTGCATGCGGAACTTTAGTCGCA GTGACACCCTGAGCGAGCATATTCGCACGCATACGGGAGAGAAGCCATTTGCATGCG ACATCTGCGGTAGAAAGTTTGCGAGGCGCTGGACGTTGGTAGGCCACACGAAAATCC ATACAGGCTCCCAGAAACCCTTCCAGTGCAGAATTTGTATGCGCAATTTTAGTGACAG AAGTAACTTGTCCCGACATATAAGGACGCACACCGGCGAAAAACCGTTTGCCTGTGAT ATCTGTGGTCGGAAATTCGCCCAGTCCGGTGACTTGACACGGCATACCAAAATACACA CTGGAAGCCAAAAGCCTTTTCAGTGTCGCATATGTATGCGCAACTTCAGCCAGAGTAG TGACCTTTCACGGCATATACGGACGCATACGGGTGAGAAACCCTTCGCCTGTGACATT TGCGGGCGAAAGTTTGCATATCATTGGTACCTGAAAAAACATACGAAAATACATTTGA GACAAAAAGATGCAGCCCGG | ZFP DNA sequence |
| 908 | GCTGCCATGGCCGAGCGCCCGTTTCAATGCAGAATATGTATGAGGAACTTCTCTAGAA GCGCCAATCTTGCGCGACACATTAGAACTCACACAGGCGAGAAACCTTTCGCCTGTGA CATCTGCGGCAGAAAATTTGCGCGAAGTGATAACTTGCGCGAGCACACAAAAATCCA TACCGGTTCCCAAAAGCCCTTTCAATGTAGGATTTGCATGGAACTTTTCAAGACCA TACACGCTGAGACTCCACATTCGCACGCATACGGGAGAAAAACCATTTGCTTGTGACA TATGCGGCCGAAAGTTTGCACACCGATCCAACTTGAATAAGCATACCAAAATCCATAC GGGGTCTCAGAAACCCTTCCAGTGTCGGATTTGTATGCGAAACTTCTCTCAGAGTGGT TCTCTTACGCGCCACATTAGAACCCACACGGGGGAAAAGCCATTCGCGTGCGATATCT GTGGCCGGAAATTTGCTACTTCCGCAAATCTTTCTCGACATACAAAGATACATCTTAG ACAGAAGGATGCGGCACGG | ZFP DNA sequence |
| 909 | TTGGAGCCCGGTGAAAAACCATATGCCTGTCCAGAGTGTGGAAAAAGTTTTAGCAGA AGCGACGACCTGGTTAGGCATCAACGAACTCACACAGGGGAAAAGCCGTACAAATGT CCTGAATGCGGAAAGTCATTCTCCACTTCAGGTAGCCTCGTGCGACATCAGCGCACAC ATACTGGCGAAAAACCTTATAAGTGTCCGGAATGCGGCAAGAGTTTTTCTAGAAGTGA TAAGCTCGTGCGACACCAGCGGACGCACACGGGTGAGAAGCCCTACGCCTGCCCAGA GTGCGGAAAGTCCTTTAGTAGGTCTGACGAACTGGTCCGGCCACCAACGAACCCATACA GGGGAGAAACCCTACAAATGTCCAGAGTGCGGGAAATCATTTTCAACGTCTCACAGCT TGACGGAACATCAGAGGACCCATACAGGCGAAAAGCCTTACAAATGTCCGGAGTGCG GAAAGTCTTTCAGCCGGGCTGATAATCTCACGGAGCACCAAAGAACCCACACGGGTA AGAAAACCTCT | ZFP DNA sequence |
| 910 | TTGGAGCCGGAGAAAAGCCATATGCCTGTCCGGAATGCGGCAAAAGCTTTTCAGAA CGGTCCCATTTGCGGGAACATCAGCGCACCCATACCGGAGAAAAGCCTTACAAGTGTC CCGAGTGTGGTAAGAGCTTTTCAACTTCCCACAGTCTCACTGAACATCAGCGAACTCA CACAGGCGAAAAACCATACAAATGCCCGGAGTGTGGAAAGAGTTTTTCTCAAGCTGG GCACTTGGCCAGCCACCAAAGGACTCATACGGGCGAGAAACCGTATGCCTGTCCAGA ATGCGGGAAATCATTTTCTACTAGTCATTCCCTTACGGAACATCAGAGAACGCACACC GGGGAGAAGCCATACAAGTGTCCGGAGTGCGGAAATCATTCTCCGACCCGGGTCAT CTCGTTCGCCATCAGAGGACTCATACTGGAGAGAAACCGTATAAATGTCCTGAATGCG GGAAGAGCTTTTCTACATCTGGGAACCTTGTGCGGCACCAGCGAACCCACACGGGGA AAAAGACTTCT | ZFP DNA sequence |
| 911 | CTGGAACCGGGTGAAAAACCCTACGCTTGTCCCGAGTGTGGGAAATCATTCTCAAGGG CAGATAATCTTACGGAACATCAGCGCACACACACCGGGGAAAAACCCTATAAGTGCC CTGAGTGTGGTAAATCATTCTCTACGTCAGGGTCATTGGTGCGCCATCAGAGGACCCA TACAGGCGAAAAACCGTATAAGTGCCCCGAATGCGGTAAAGCTTCAGCAGAAAAGA TAACTTGAAAAATCACCAACGCACTCACACGGGAGAAAAACCGTACGCATGCCCGGA GTGCGGCAAGAGTTTCAGTCAGAGTAGCTCACTTGTTCGCCACCAAAGAACCCACACA GGCGAAAAGCCCTACAAGTGTCCTGAATGTGGAAAGAGTTTCAGTCGAAGTGATAAA TTGGTTAGGCACCAAAGAACACACACTGGAGAGAAACCGTACAAGTGTCCAGAATGT GGCAAGTCTTTTTCTGATTCTGGAAATTTGCGCGTCCATCAAAGGACTCATACTGGGA AAAAGACGTCC | ZFP DNA sequence |
| 912 | CTCGAACCAGGGGAAAAGCCATACGCTTGCCCCGAGTGTGGAAAATCTTTCTCTCAGT CAAGCTCCCTTGTCAGACACCAGAGAACCCATACGGGTGAGAAACCATACAAGTGCC CAGAGTGCGGCAAAAGCTTCAGTCAGAGTGGCGATCTGCGCCGGCATCAAAGAACTC ACACTGGAGAAAGCCCTATAAGTGCCCCGAATGTGGAAAGAGTTTTTTCCAGGAGTG ACGAAAGAAAGAGACACCAGCGGACTCACACCGGCGAGAAACCATACGCATGCCCG AGTGCGGAAAAAGTTTTTCCCACCGCACAACCCTTACCAATCATCAACGCACGCACAC AGGGGAGAAACCCTACAAGTGCCCGGAGTGTGGCAAGTCATTCAGCCGAAGTGACCA CCTCACTAACCACCAAAGGACTCACACAGGAGAAAACCCTACAAATGTCCGGAGTG CGGAAAATCTTTTTCCACGTCCGGTGAGCTGGTCCGCCATCAACGAACCCATACTGGT AAAAAAACTAGC | ZFP DNA sequence |
| 913 | CTGGAACCCGGGGAGAAGCCGTACGCTTGCCCAGAGTGCGGAAAGAGCTTCTCTCAG AGCGGAGACCTTAGACGCCACCAGCGAACCCACACCGGCGAAAAACCGTATAAATGC CCGGAATGCGGCAAGAGTTTTAGTCGGTCCGATGAGCGAAAGAGGCATCAACGAACC CATACGGGAGAGAAACCCTACAAGTGCCCTGAGTGTGGTAAGTCATTTTCCCACGAAA CGACGTTGACGAATCACCAGAGAACCCATACGGGTGAGAAACCTTACGCTTGCCCGG AGTGCGGCAAAAGCTTCAGCCGGAGTGATCACTTGACCAATCATCAGAGGACACACA CGGGTGAGAAGCCCTACAAATGTCCCGAATGCGGCAAGTCTTTCTCAACGTCAGGCGA ACTCGTCCGGCACCAGCGAACACATACGGGAGAAAAGCCGTACAAATGTCCGGAATG | ZFP DNA sequence |

TABLE 8-continued eZFP DNA sequences

| SEQ ID NOs | Sequence | Description |
|---|---|---|
| | CGGAAAGTCATTTTCACGGTCAGATGACTTGGTGCGACACCAGCGCACTCACACAGGC<br>AAGAAGACCTCA | |
| 914 | CTGGAGCCTGGTGAGAAGCCGTATGCATGTCCTGAGTGTGGGAAGTCATTTAGTCAGA<br>GGGCCCACTTGGAACGACACCAAAGGACCCACACTGGTGAAAAACCCTACAAATGCC<br>CAGAGTGTGGTAAGTCTTTTTCACAGCTGGCCCACCTGAGAGCACACCAGCGAACTCA<br>TACGGGCGAGAAACCATACAAGTGTCCAGAGTGCGGAAAGTCATTCTCAGATCCCGG<br>CCACTTGGTGCGACATCAGAGAACGCACACAGGGGAGAAGCCTTATGCTTGCCCGGA<br>ATGCGGGAAGTCTTTCAGCCGCCGAAGTGCTTGTCGAAGGCACCAACGGACCCATACC<br>GGTGAGAAACCATATAAGTGCCCAGAGTGTGGAAAGAGTTTTAGTCGATCCGATCACC<br>TGACTACGCACCAGCGGACGCACACAGGAGAGAAACCGTATAAGTGCCCTGAATGCG<br>GTAAGAGCTTCTCTCAATCAAGCTCACTGGTTAGGCACCAACGCACTCATACCGGCAA<br>GAAGACGTCA | ZFP DNA sequence |
| 915 | CTTGAGCCGGGGGAAAAGCCTTATGCTTGCCCAGAGTGTGGCAAGAGCTTCTCCCAAA<br>GTTCAAACCTCGTCCGACACCAAAGGACTCACACGGGCGAAAAACCGTATAAATGCC<br>CCGAGTGCGGAAAGTCATTTTCCAGGTCCGACGATCTGGTCCGCCACCAGCGCACTCA<br>TACGGGGGAAAAGCCCTATAAGTGCCCTGAGTGCGGCAAGAGCTTCTCAACTCACCTG<br>GATCTCATTCGCCATCAACGCACACATACAGGGGAGAAGCCTTACGCTTGTCCAGAGT<br>GCGGCAAGTCTTTCAGTACGAGCGGAAACCTGACGGAACACCAGCGAACCCACACGG<br>GCGAGAAGCCATATAAATGTCCCGAATGTGGAAAATCATTCTCTCGCCGATCTGCGTG<br>CCGCCGGCATCAGAGGACACATACCGGAGAAAGCCGTACAAATGCCCCGAGTGTGG<br>AAAATCCTTTAGCAGAAATGATACACTTACCGAGCATCAGAGGACGCACACTGGAAA<br>AAAGACATCT | ZFP DNA sequence |

In some embodiments, the eZFP (e.g., such as an eZFP comprised in a fusion protein of an epigenetic-modifying DNA-targeting system) comprises zinc finger proteins comprising six zinc fingers denoted F1 through F6 in order from N-terminus to C-terminus. In some embodiments, the amino acid sequence of each zinc finger recognition region is as follows: 1) F1:SEADRSR(SEQ ID NO:720) F2:DRSNLTR(SEQ ID NO:721)F3:QSSDLSR(SEQ ID NO:722) F4:YHWYLKK(SEQ ID NO:723) F5:RSDSLSV(SEQ ID NO:724) F6:QNANRKT(SEQ ID NO:725); 2) F1:RSDVLST(SEQ ID NO:726) F2:DNSSRTR(SEQ ID NO:727) F3:RPYTLRL(SEQ ID NO:728) F4:DSSHRTR(SEQ ID NO:729) F5:RSDHLSQ(SEQ ID NO:730) F6:DSSHRTR(SEQ ID NO:731); 3) F1:RSDHLSQ(SEQ ID NO:732) F2:QSADRTK(SEQ ID NO:733) F3:RSDHLSQ(SEQ ID NO:734) F4:RRSDLKR(SEQ ID NO:735) F5:RSDHLSR(SEQ ID NO:736) F6:QSSDLRR(SEQ ID NO:737); 4) F1:RSDNLSE(SEQ ID NO:738) F2:TSSNRKT(SEQ ID NO:739) F3:DRSHLTR(SEQ ID NO:740) F4:RSDALTQ(SEQ ID NO:741) F5:DRSALAR(SEQ ID NO:742) F6:RRFTLSK(SEQ ID NO:743); 5) F1:RSDHLSE(SEQ ID NO:744) F2:QYSGRYY(SEQ ID NO:745) F3:HGQTLNE(SEQ ID NO:746) F4:QSGNLAR(SEQ ID NO:747) F5:RSDSLLR(SEQ ID NO:748) F6:CREYRGK(SEQ ID NO:749); 6) F1:QSANRTT(SEQ ID NO:750) F2:RSANLTR(SEQ ID NO:751) F3:RSDVLSE(SEQ ID NO:752) F4:TSGHLSR(SEQ ID NO:753) F5:QSSDLSR(SEQ ID NO:754), F6:QWSTRKR(SEQ ID NO:755); 7) F1:QSGNLAR(SEQ ID NO:756) F2:ATCCLAH(SEQ ID NO:757) F3:RWQYLPT(SEQ ID NO:758) F4:DRSALAR(SEQ ID NO:759) F5:RSDNLSE(SEQ ID NO:760)F6:KRCNLRC(SEQ ID NO:761); 8) F1:NPANLTR(SEQ ID NO:762) F2:QNATRTK(SEQ ID NO:763) F3:QSGHLAR(SEQ ID NO:764) F4:NRHDRAK(SEQ ID NO:765) F5:RSDHLSE(SEQ ID NO:766), F6:QRRSRYK(SEQ ID NO:767); 9) F1:QSSDLSR(SEQ ID NO:768) F2:HRSTRNR(SEQ ID NO:769) F3:RSDVLSA(SEQ ID NO:770) F4:DSRTRKN(SEQ ID NO:771) F5:QSGSLTR(SEQ ID NO:772) F6:DQSGLAH(SEQ ID NO:773); 10) F1:QNPAQWR(SEQ ID NO:774) F2:RSADLSR(SEQ ID NO:775) F3:TSGSLSR(SEQ ID NO:776) F4:RSDHLSR(SEQ ID NO:777) F5:RSDSLLR (SEQ ID NO:778) F6:QSYDRFQ(SEQ ID NO:779); 11) F1:TSGSLSR(SEQ ID NO:780) F2:RSDHLSR(SEQ ID NO:781) F3:RSDSLLR(SEQ ID NO:782) F4:QSYDRFQ (SEQ ID NO:783) F5:RSDNLST(SEQ ID NO:784) F6:DNRDRIK(SEQ ID NO:785); 12) F1:DRSNLSR(SEQ ID NO:786) F2:LRQNLIM(SEQ ID NO:787) F3:ERGTLAR(SEQ ID NO:788) F4:RSDALTQ(SEQ ID NO:789) F5:RSDSLSQ(SEQ ID NO:790) F6:RKADRTR(SEQ ID NO:791); 13) F1:QYCCLTN(SEQ ID NO:792) F2:TSGNLTR(SEQ ID NO:793) F3:QSSDLSR(SEQ ID NO:794) F4:FRYYLKR(SEQ ID NO:795) F5:QSGDLTR (SEQ ID NO:796) F6:DKGNLTK(SEQ ID NO:797); 14) F1:TSGSLSR(SEQ ID NO:798) F2:RSDNLTT(SEQ ID NO:799) F3:QSGNLAR(SEQ ID NO:800) F4:DRTTLMR (SEQ ID NO:801) F5:QSGHLAR(SEQ ID NO:802) F6:QLTHLNS(SEQ ID NO:803); 15) F1:IKHDLHR(SEQ ID NO:804) F2:RSANLTR(SEQ ID NO:805) F3:RSDNLAR(SEQ ID NO:806) F4:QNVSRPR(SEQ ID NO:807) F5:RSDDLSK(SEQ ID NO:808) F6:DSSHRTR(SEQ ID NO:809); 16) F1:RSDNLAR(SEQ ID NO:810) F2:QNVSRPR(SEQ ID NO:811) F3:RSDDLSK(SEQ ID NO:812) F4:DSSHRTR(SEQ ID NO:813) F5:TSSNRKT (SEQ ID NO:814) F6:AQWTRAC(SEQ ID NO:815); 17) F1:RSDDLSK(SEQ ID NO:816) F2:DSSHRTR(SEQ ID NO:817) F3:TSSNRKT(SEQ ID NO:818) F4:AQWTRAC (SEQ ID NO:819) F5:RKQTRTT(SEQ ID NO:820) F6:HRSSLRR(SEQ ID NO:821); 18) F1:QSAHRKN(SEQ ID NO:822) F2:TSSNRKT(SEQ ID NO:823) F3:RSDNLSA(SEQ ID NO:824) F4:RNNDRKT(SEQ ID NO:825) F5:TSGSLSR(SEQ ID NO:826) F6:QAGHLAK (SEQ ID NO:827); 19) F1:RSDHLSQ(SEQ ID NO:828) F2:ASSTRTK(SEQ ID NO:829) F3:RSDDLTR(SEQ ID NO:830) F4:QKSNLSS(SEQ ID NO:831) F5:QSANRTT (SEQ ID NO:832) F6:QNATRTK(SEQ ID NO:833); 20)

F1:RSDTLSE(SEQ ID NO:834) F2:RRWTLVG(SEQ ID NO:835) F3:DRSNLSR(SEQ ID NO:836) F4:QSGDLTR (SEQ ID NO:837) F5:QSSDLSR(SEQ ID NO:838) F6:YHWYLKK(SEQ ID NO:839); 21) F1:RSANLAR(SEQ ID NO:840) F2:RSDNLRE(SEQ ID NO:841) F3:RPYTLRL(SEQ ID NO:842) F4:HRSNLNK(SEQ ID NO:843) F5:QSGSLTR(SEQ ID NO:844) F6:TSANLSR(SEQ ID NO:845); m22) F1:RSDDLVR(SEQ ID NO:846) F2:TSGSLVR(SEQ ID NO:847) F3:RSDKLVR(SEQ ID NO:848) F4:RSDELVR(SEQ ID NO:849) F5:TSHSLTE (SEQ ID NO:850) F6:RADNLTE(SEQ ID NO:851); 23) F1:ERSHLRE(SEQ ID NO:852) F2:TSHSLTE(SEQ ID NO:853) F3:QAGHLAS(SEQ ID NO:854) F4:TSHSLTE (SEQ ID NO:855) F5:DPGHLVR(SEQ ID NO:856) F6:TSGNLVR(SEQ ID NO:857); 24) F1:RADNLTE(SEQ ID NO:858) F2:TSGSLVR(SEQ ID NO:859) F3:RKDNLKN(SEQ ID NO:860) F4:QSSSLVR(SEQ ID NO:861) F5:RSDKLVR(SEQ ID NO:862) F6:DSGNLRV (SEQ ID NO:863); 25) F1:QSSSLVR(SEQ ID NO:864) F2:QSGDLRR(SEQ ID NO:865) F3:RSDERKR(SEQ ID NO:866) F4:HRTTLTN(SEQ ID NO:867) F5:RSDHLTN (SEQ ID NO:868) F6:TSGELVR(SEQ ID NO:869); 26) F1:QSGDLRR(SEQ ID NO:870) F2:RSDERKR(SEQ ID NO:871) F3:HRTTLTN(SEQ ID NO:872) F4:RSDHLTN (SEQ ID NO:873) F5:TSGELVR(SEQ ID NO:874) F6:RSDDLVR(SEQ ID NO:875); 27) F1:QRAHLER(SEQ ID NO:876) F2:QLAHLRA(SEQ ID NO:877) F3:DPGHLVR(SEQ ID NO:878) F4:RRSACRR(SEQ ID NO:879) F5:RSDHLTT(SEQ ID NO:880) F6:QSSSLVR (SEQ ID NO:881); and 28) F1:QSSNLVR(SEQ ID NO:882) F2:RSDDLVR(SEQ ID NO:883) F3:THLDLIR(SEQ ID NO:884) F4:TSGNLTE(SEQ ID NO:885) F5:RRSACRR (SEQ ID NO:886) F6:RNDTLTE(SEQ ID NO:887).

In some embodiments, the eZFP (e.g., such as an eZFP comprised in a fusion protein of an epigenetic-modifying DNA-targeting system) comprises sequence set forth in any one of SEQ ID NOS: 692-719, or a portion thereof, or an amino acid sequence that has at least 90%, 91%, 92%, 93%, 94%, 95%, 96%, 97%, 98%, or 99% sequence identity thereto. In some embodiments, the eZFP is encoded by the sequence set forth in any one of SEQ ID NOS:888-915, or a portion thereof, or nucleotide sequence that has at least 90%, 91%, 92%, 93%, 94%, 95%, 96%, 97%, 98%, or 99% sequence identity thereto.

In some embodiments, provided herein is an eZFP (e.g., such as an eZFP comprised in a fusion protein of an epigenetic-modifying DNA-targeting system), such as eZFP_1 as described herein. In some embodiments, the eZFP targets a target site comprising the nucleotide sequence set forth in SEQ ID NO:1028, a contiguous portion thereof of at least 12 nt, or a complementary sequence of any of the foregoing. In some embodiments, the eZFP targets a target site comprising the nucleotide sequence set forth in SEQ ID NO:1028. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:SEADRSR(SEQ ID NO:720) F2:DRSNLTR (SEQ ID NO:721) F3:QSSDLSR(SEQ ID NO:722) F4:YHWYLKK(SEQ ID NO:723) F5:RSDSLSV(SEQ ID NO:724) F6:QNANRKT(SEQ ID NO:725): In some embodiments, the eZFP comprises the amino acid sequence set forth in SEQ ID NO:692, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:692. In some embodiments, the eZFP is encoded by the nucleotide sequence set forth in SEQ ID NO:888, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:888.

In some embodiments, provided herein is an eZFP (e.g., such as an eZFP comprised in a fusion protein of an epigenetic-modifying DNA-targeting system), such as eZFP_2 as described herein. In some embodiments, the eZFP targets a target site comprising the nucleotide sequence set forth in SEQ ID NO:1029, a contiguous portion thereof of at least 12 nt, or a complementary sequence of any of the foregoing. In some embodiments, the eZFP targets a target site comprising the nucleotide sequence set forth in SEQ ID NO:1029. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:RSDVLST(SEQ ID NO:726) F2:DNSSRTR (SEQ ID NO:727) F3:RPYTLRL(SEQ ID NO:728) F4:DSSHRTR(SEQ ID NO:729) F5:RSDHLSQ(SEQ ID NO:730) F6:DSSHRTR(SEQ ID NO:731). In some embodiments, the eZFP comprises the amino acid sequence set forth in SEQ ID NO:693, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:693. In some embodiments, the eZFP is encoded by the nucleotide sequence set forth in SEQ ID NO:889, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:889.

In some embodiments, provided herein is an eZFP (e.g., such as an eZFP comprised in a fusion protein of an epigenetic-modifying DNA-targeting system), such as eZFP_3 as described herein. In some embodiments, the eZFP targets a target site comprising the nucleotide sequence set forth in SEQ ID NO:1030, a contiguous portion thereof of at least 12 nt, or a complementary sequence of any of the foregoing. In some embodiments, the eZFP targets a target site comprising the nucleotide sequence set forth in SEQ ID NO:1030. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:RSDHLSQ(SEQ ID NO:732) F2:QSADRTK (SEQ ID NO:733) F3:RSDHLSQ(SEQ ID NO:734) F4:RRSDLKR(SEQ ID NO:735) F5:RSDHLSR(SEQ ID NO:736) F6:QSSDLRR(SEQ ID NO:737). In some embodiments, the eZFP comprises the amino acid sequence set forth in SEQ ID NO:694, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:694. In some embodiments, the eZFP is encoded by the nucleotide sequence set forth in SEQ ID NO:890, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:890.

In some embodiments, provided herein is an eZFP (e.g., such as an eZFP comprised in a fusion protein of an epigenetic-modifying DNA-targeting system), such as eZFP_4 as described herein. In some embodiments, the eZFP targets a target site comprising the nucleotide sequence set forth in SEQ ID NO:1031, a contiguous portion thereof of at least 12 nt, or a complementary sequence of any of the foregoing. In some embodiments, the eZFP targets a target site comprising the nucleotide sequence set forth in SEQ ID NO:1031. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:RSDNLSE(SEQ ID NO:738) F2:TSSNRKT (SEQ ID NO:739) F3:DRSHLTR(SEQ ID NO:740) F4:RSDALTQ(SEQ ID NO:741) F5:DRSALAR(SEQ ID NO:742) F6:RRFTLSK(SEQ ID NO:743). In some embodiments, the eZFP comprises the amino acid sequence set forth in SEQ ID NO:695, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:695. In some embodiments, the eZFP is encoded by the nucleotide sequence set forth in SEQ ID NO:891, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:891.

In some embodiments, provided herein is an eZFP (e.g., such as an eZFP comprised in a fusion protein of an epigenetic-modifying DNA-targeting system), such as eZFP_5 as described herein. In some embodiments, the eZFP targets a target site comprising the nucleotide sequence set forth in SEQ ID NO:1032, a contiguous portion thereof of at least 12 nt, or a complementary sequence of any of the foregoing. In some embodiments, the eZFP targets a target site comprising the nucleotide sequence set forth in SEQ ID NO:1032. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:RSDHLSE(SEQ ID NO:744) F2:QYSGRYY (SEQ ID NO:745) F3:HGQTLNE(SEQ ID NO:746) F4:QSGNLAR(SEQ ID NO:747) F5:RSDSLLR(SEQ ID NO:748) F6:CREYRGK(SEQ ID NO:749). In some embodiments, the eZFP comprises the amino acid sequence set forth in SEQ ID NO:696, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:696. In some embodiments, the eZFP is encoded by the nucleotide sequence set forth in SEQ ID NO:892, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:892.

In some embodiments, provided herein is an eZFP (e.g., such as an eZFP comprised in a fusion protein of an epigenetic-modifying DNA-targeting system), such as eZFP_6 as described herein. In some embodiments, the eZFP targets a target site comprising the nucleotide sequence set forth in SEQ ID NO:1033, a contiguous portion thereof of at least 12 nt, or a complementary sequence of any of the foregoing. In some embodiments, the eZFP targets a target site comprising the nucleotide sequence set forth in SEQ ID NO:1033. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:QSANRTT(SEQ ID NO:750) F2:RSANLTR (SEQ ID NO:751) F3:RSDVLSE(SEQ ID NO:752) F4:TSGHLSR(SEQ ID NO:753) F5:QSSDLSR(SEQ ID NO:754) F6:QWSTRKR(SEQ ID NO:755). In some embodiments, the eZFP comprises the amino acid sequence set forth in SEQ ID NO:697, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:697. In some embodiments, the eZFP is encoded by the nucleotide sequence set forth in SEQ ID NO:893, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:893.

In some embodiments, provided herein is an eZFP (e.g., such as an eZFP comprised in a fusion protein of an epigenetic-modifying DNA-targeting system), such as eZFP_7 as described herein. In some embodiments, the eZFP targets a target site comprising the nucleotide sequence set forth in SEQ ID NO:1034, a contiguous portion thereof of at least 12 nt, or a complementary sequence of any of the foregoing. In some embodiments, the eZFP targets a target site comprising the nucleotide sequence set forth in SEQ ID NO:1034. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:QSGNLAR(SEQ ID NO:756) F2:ATCCLAH (SEQ ID NO:757) F3:RWQYLPT(SEQ ID NO:758) F4:DRSALAR(SEQ ID NO:759) F5:RSDNLSE(SEQ ID NO:760) F6:KRCNLRC(SEQ ID NO:761). In some embodiments, the eZFP comprises the amino acid sequence set forth in SEQ ID NO:698, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:698. In some embodiments, the eZFP is encoded by the nucleotide sequence set forth in SEQ ID NO:894, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:894.

In some embodiments, provided herein is an eZFP (e.g., such as an eZFP comprised in a fusion protein of an epigenetic-modifying DNA-targeting system), such as eZFP_8 as described herein. In some embodiments, the eZFP targets a target site comprising the nucleotide sequence set forth in SEQ ID NO:1035, a contiguous portion thereof of at least 12 nt, or a complementary sequence of any of the foregoing. In some embodiments, the eZFP targets a target site comprising the nucleotide sequence set forth in SEQ ID NO:1035. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:NPANLTR(SEQ ID NO:762) F2:QNATRTK (SEQ ID NO:763) F3:QSGHLAR(SEQ ID NO:764) F4:NRHDRAK(SEQ ID NO:765) F5:RSDHLSE(SEQ ID NO:766) F6:QRRSRYK(SEQ ID NO:767). In some embodiments, the eZFP comprises the amino acid sequence set forth in SEQ ID NO:699, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:699. In some embodiments, the eZFP is encoded by the nucleotide sequence set forth in SEQ ID NO:895, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:895.

In some embodiments, provided herein is an eZFP (e.g., such as an eZFP comprised in a fusion protein of an epigenetic-modifying DNA-targeting system), such as eZFP_9 as described herein. In some embodiments, the eZFP targets a target site comprising the nucleotide sequence set forth in SEQ ID NO:1036, a contiguous portion thereof of at least 12 nt, or a complementary sequence of any of the foregoing. In some embodiments, the eZFP targets a target site comprising the nucleotide sequence set forth in SEQ ID NO:1036. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:QSSDLSR(SEQ ID NO:768) F2:HRSTRNR (SEQ ID NO:769) F3:RSDVLSA(SEQ ID NO:770) F4:DSRTRKN(SEQ ID NO:771) F5:QSGSLTR(SEQ ID NO:772) F6:DQSGLAH(SEQ ID NO:773). In some embodiments, the eZFP comprises the amino acid sequence set forth in SEQ ID NO:700, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:700. In some embodiments, the eZFP is encoded by the nucleotide sequence set forth in SEQ ID NO:896, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:896.

In some embodiments, provided herein is an eZFP (e.g., such as an eZFP comprised in a fusion protein of an epigenetic-modifying DNA-targeting system), such as eZFP_10 as described herein. In some embodiments, the eZFP targets a target site comprising the nucleotide sequence set forth in SEQ ID NO:1037, a contiguous portion thereof of at least 12 nt, or a complementary sequence of any of the foregoing. In some embodiments, the eZFP targets a target site comprising the nucleotide sequence set forth in SEQ ID NO:1037. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:QNPAQWR(SEQ ID NO:774) F2:RSADLSR (SEQ ID NO:775) F3:TSGSLSR(SEQ ID NO:776) F4:RSDHLSR(SEQ ID NO:777) F5:RSDSLLR(SEQ ID NO:778) F6:QSYDRFQ(SEQ ID NO:779). In some embodiments, the eZFP comprises the amino acid sequence set forth in SEQ ID NO:701, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:701. In some embodiments, the eZFP is encoded by the nucleotide sequence set forth in SEQ ID NO:897, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:897.

In some embodiments, provided herein is an eZFP (e.g., such as an eZFP comprised in a fusion protein of an epigenetic-modifying DNA-targeting system), such as eZFP_11 as described herein. In some embodiments, the eZFP targets a target site comprising the nucleotide sequence set forth in SEQ ID NO:1038, a contiguous portion thereof of at least 12 nt, or a complementary sequence of any of the foregoing. In some embodiments, the eZFP targets a target site comprising the nucleotide sequence set forth in SEQ ID NO:1038. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:TSGSLSR(SEQ ID NO:780) F2:RSDHLSR (SEQ ID NO:781) F3:RSDSLLR(SEQ ID NO:782) F4:QSYDRFQ(SEQ ID NO:783) F5:RSDNLST(SEQ ID NO:784) F6:DNRDRIK(SEQ ID NO:785). In some embodiments, the eZFP comprises the amino acid sequence set forth in SEQ ID NO:702, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:702. In some embodiments, the eZFP is encoded by the nucleotide sequence set forth in SEQ ID NO:898, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:898.

In some embodiments, provided herein is an eZFP (e.g., such as an eZFP comprised in a fusion protein of an epigenetic-modifying DNA-targeting system), such as eZFP_12 as described herein. In some embodiments, the eZFP targets a target site comprising the nucleotide sequence set forth in SEQ ID NO:1039, a contiguous portion thereof of at least 12 nt, or a complementary sequence of any of the foregoing. In some embodiments, the eZFP targets a target site comprising the nucleotide sequence set forth in SEQ ID NO:1039. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:DRSNLSR(SEQ ID NO:786) F2:LRQNLIM (SEQ ID NO:787) F3:ERGTLAR(SEQ ID NO:788) F4:RSDALTQ(SEQ ID NO:789) F5:RSDSLSQ(SEQ ID NO:790) F6:RKADRTR(SEQ ID NO:791). In some embodiments, the eZFP comprises the amino acid sequence set forth in SEQ ID NO:703, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:703. In some embodiments, the eZFP is encoded by the nucleotide sequence set forth in SEQ ID NO:899, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:899.

In some embodiments, provided herein is an eZFP (e.g., such as an eZFP comprised in a fusion protein of an epigenetic-modifying DNA-targeting system), such as eZFP_13 as described herein. In some embodiments, the eZFP targets a target site comprising the nucleotide sequence set forth in SEQ ID NO:1040, a contiguous portion thereof of at least 12 nt, or a complementary sequence of any of the foregoing. In some embodiments, the eZFP targets a target site comprising the nucleotide sequence set forth in SEQ ID NO:1040. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:QYCCLTN(SEQ ID NO:792) F2:TSGNLTR (SEQ ID NO:793) F3:QSSDLSR(SEQ ID NO:794) F4:FRYYLKR(SEQ ID NO:795) F5:QSGDLTR(SEQ ID NO:796) F6:DKGNLTK(SEQ ID NO:797). In some embodiments, the eZFP comprises the amino acid sequence set forth in SEQ ID NO:704, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:704. In some embodiments, the eZFP is encoded by the nucleotide sequence set forth in SEQ ID NO:900, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:900.

In some embodiments, provided herein is an eZFP (e.g., such as an eZFP comprised in a fusion protein of an epigenetic-modifying DNA-targeting system), such as eZFP_14 as described herein. In some embodiments, the eZFP targets a target site comprising the nucleotide sequence set forth in SEQ ID NO:1041, a contiguous portion thereof of at least 12 nt, or a complementary sequence of any of the foregoing. In some embodiments, the eZFP targets a target site comprising the nucleotide sequence set forth in SEQ ID NO:1041. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:TSGSLSR(SEQ ID NO:798) F2:RSDNLTT (SEQ ID NO:799) F3:QSGNLAR(SEQ ID NO:800) F4:DRTTLMR(SEQ ID NO:801) F5:QSGHLAR(SEQ ID NO:802) F6:QLTHLNS(SEQ ID NO:803). In some embodiments, the eZFP comprises the amino acid sequence set forth in SEQ ID NO:705, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:705. In some embodiments, the eZFP is encoded by the nucleotide sequence set forth in SEQ ID NO:901, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:901.

In some embodiments, provided herein is an eZFP (e.g., such as an eZFP comprised in a fusion protein of an epigenetic-modifying DNA-targeting system), such as eZFP_15 as described herein. In some embodiments, the eZFP targets a target site comprising the nucleotide sequence set forth in SEQ ID NO:1042, a contiguous portion thereof of at least 12 nt, or a complementary sequence of any of the foregoing. In some embodiments, the eZFP targets a target site comprising the nucleotide sequence set forth in SEQ ID NO:1042. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:IKHDLHR(SEQ ID NO:804) F2:RSANLTR (SEQ ID NO:805) F3:RSDNLAR(SEQ ID NO:806) F4:QNVSRPR(SEQ ID NO:807) F5:RSDDLSK(SEQ ID NO:808) F6:DSSHRTR(SEQ ID NO:809). In some embodiments, the eZFP comprises the amino acid sequence set forth in SEQ ID NO:706, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:706. In some embodiments, the eZFP is encoded by the nucleotide sequence set forth in SEQ ID NO:902, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:902.

In some embodiments, provided herein is an eZFP (e.g., such as an eZFP comprised in a fusion protein of an epigenetic-modifying DNA-targeting system), such as eZFP_16 as described herein. In some embodiments, the eZFP targets a target site comprising the nucleotide sequence set forth in SEQ ID NO:1043, a contiguous portion thereof of at least 12 nt, or a complementary sequence of any of the foregoing. In some embodiments, the eZFP targets a target site comprising the nucleotide sequence set forth in SEQ ID NO:1043. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:RSDNLAR(SEQ ID NO:810) F2:QNVSRPR (SEQ ID NO:811) F3:RSDDLSK(SEQ ID NO:812) F4:DSSHRTR(SEQ ID NO:813) F5:TSSNRKT(SEQ ID NO:814) F6:AQWTRAC(SEQ ID NO:815). In some embodiments, the eZFP comprises the amino acid sequence set forth in SEQ ID NO:707, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:707. In some embodiments, the eZFP is encoded by the nucleotide sequence set forth in SEQ ID NO:903, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:903.

In some embodiments, provided herein is an eZFP (e.g., such as an eZFP comprised in a fusion protein of an epigenetic-modifying DNA-targeting system), such as eZFP_17 as described herein. In some embodiments, the eZFP targets a target site comprising the nucleotide sequence set forth in SEQ ID NO:1044, a contiguous portion thereof of at least 12 nt, or a complementary sequence of any of the foregoing. In some embodiments, the eZFP targets a target site comprising the nucleotide sequence set forth in SEQ ID NO:1044. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:RSDDLSK(SEQ ID NO:816) F2:DSSHRTR (SEQ ID NO:817) F3:TSSNRKT(SEQ ID NO:818) F4:AQWTRAC(SEQ ID NO:819) F5:RKQTRTT(SEQ ID NO:820) F6:HRSSLRR(SEQ ID NO:821). In some embodiments, the eZFP comprises the amino acid sequence set forth in SEQ ID NO:708, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:708. In some embodiments, the eZFP is encoded by the nucleotide sequence set forth in SEQ ID NO:904, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:904.

In some embodiments, provided herein is an eZFP (e.g., such as an eZFP comprised in a fusion protein of an epigenetic-modifying DNA-targeting system), such as eZFP_18 as described herein. In some embodiments, the eZFP targets a target site comprising the nucleotide sequence set forth in SEQ ID NO:1045, a contiguous portion thereof of at least 12 nt, or a complementary sequence of any of the foregoing. In some embodiments, the eZFP targets a target site comprising the nucleotide sequence set forth in SEQ ID NO:1045. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:QSAHRKN(SEQ ID NO:822) F2:TSSNRKT (SEQ ID NO:823) F3:RSDNLSA(SEQ ID NO:824) F4:RNNDRKT(SEQ ID NO:825) F5:TSGSLSR(SEQ ID NO:826) F6:QAGHLAK(SEQ ID NO:827). In some embodiments, the eZFP comprises the amino acid sequence set forth in SEQ ID NO:709, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:709. In some embodiments, the eZFP is encoded by the nucleotide sequence set forth in SEQ ID NO:905, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:905.

In some embodiments, provided herein is an eZFP (e.g., such as an eZFP comprised in a fusion protein of an epigenetic-modifying DNA-targeting system), such as eZFP_19 as described herein. In some embodiments, the eZFP targets a target site comprising the nucleotide sequence set forth in SEQ ID NO:1046, a contiguous portion thereof of at least 12 nt, or a complementary sequence of any of the foregoing. In some embodiments, the eZFP targets a target site comprising the nucleotide sequence set forth in SEQ ID NO:1046. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:RSDHLSQ(SEQ ID NO:828) F2:ASSTRTK (SEQ ID NO:829) F3:RSDDLTR(SEQ ID NO:830) F4:QKSNLSS(SEQ ID NO:831) F5:QSANRTT(SEQ ID NO:832) F6:QNATRTK(SEQ ID NO:833). In some embodiments, the eZFP comprises the amino acid sequence set forth in SEQ ID NO:710, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:710. In some embodiments, the eZFP is encoded by the nucleotide sequence set forth in SEQ ID NO:906, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:906.

In some embodiments, provided herein is an eZFP (e.g., such as an eZFP comprised in a fusion protein of an epigenetic-modifying DNA-targeting system), such as eZFP_20 as described herein. In some embodiments, the eZFP targets a target site comprising the nucleotide sequence set forth in SEQ ID NO:1047, a contiguous portion thereof of at least 12 nt, or a complementary sequence of any of the foregoing. In some embodiments, the eZFP targets a target site comprising the nucleotide sequence set forth in SEQ ID NO:1047. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:RSDTLSE(SEQ ID NO:834) F2:RRWTLVG (SEQ ID NO:835) F3:DRSNLSR(SEQ ID NO:836) F4:QSGDLTR(SEQ ID NO:837) F5:QSSDLSR(SEQ ID NO:838) F6:YHWYLKK(SEQ ID NO:839). In some embodiments, the eZFP comprises the amino acid sequence set forth in SEQ ID NO:711, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:711. In some embodiments, the eZFP is encoded by the nucleotide sequence set forth in SEQ ID NO:907, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:907.

In some embodiments, provided herein is an eZFP (e.g., such as an eZFP comprised in a fusion protein of an epigenetic-modifying DNA-targeting system), such as eZFP_21 as described herein. In some embodiments, the eZFP targets a target site comprising the nucleotide sequence set forth in SEQ ID NO:1048, a contiguous portion thereof of at least 12 nt, or a complementary sequence of any of the foregoing. In some embodiments, the eZFP targets a target site comprising the nucleotide sequence set forth in SEQ ID NO:1048. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:RSANLAR(SEQ ID NO:840) F2:RSDNLRE (SEQ ID NO:841) F3:RPYTLRL(SEQ ID NO:842) F4:HRSNLNK(SEQ ID NO:843) F5:QSGSLTR(SEQ ID NO:844) F6:TSANLSR(SEQ ID NO:845). In some embodiments, the eZFP comprises the amino acid sequence set forth in SEQ ID NO:712, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:712. In some embodiments, the eZFP is encoded by the nucleotide sequence set forth in SEQ ID NO:908, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:908.

In some embodiments, provided herein is an eZFP (e.g., such as an eZFP comprised in a fusion protein of an epigenetic-modifying DNA-targeting system), such as eZFP_22 as described herein. In some embodiments, the eZFP targets a target site comprising the nucleotide sequence set forth in SEQ ID NO:1049, a contiguous portion thereof of at least 12 nt, or a complementary sequence of any of the foregoing. In some embodiments, the eZFP targets a target site comprising the nucleotide sequence set forth in SEQ ID NO:1049. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:RSDDLVR(SEQ ID NO:846) F2:TSGSLVR (SEQ ID NO:847) F3:RSDKLVR(SEQ ID NO:848) F4:RSDELVR(SEQ ID NO:849) F5:TSHSLTE(SEQ ID NO:850) F6:RADNLTE(SEQ ID NO:851). In some embodiments, the eZFP comprises the amino acid sequence set forth in SEQ ID NO:713, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:713. In some embodiments, the eZFP is encoded by the nucleotide sequence set forth in SEQ ID NO:909, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:909.

In some embodiments, provided herein is an eZFP (e.g., such as an eZFP comprised in a fusion protein of an epigenetic-modifying DNA-targeting system), such as eZFP_23 as described herein. In some embodiments, the eZFP targets a target site comprising the nucleotide sequence set forth in SEQ ID NO:1050, a contiguous portion thereof of at least 12 nt, or a complementary sequence of any of the foregoing. In some embodiments, the eZFP targets a target site comprising the nucleotide sequence set forth in SEQ ID NO:1050. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:ERSHLRE(SEQ ID NO:852) F2:TSHSLTE (SEQ ID NO:853) F3:QAGHLAS(SEQ ID NO:854) F4:TSHSLTE(SEQ ID NO:855) F5:DPGHLVR(SEQ ID NO:856) F6:TSGNLVR(SEQ ID NO:857). In some embodiments, the eZFP comprises the amino acid sequence set forth in SEQ ID NO:714, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:714. In some embodiments, the eZFP is encoded by the nucleotide sequence set forth in SEQ ID NO:910, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:910.

In some embodiments, provided herein is an eZFP (e.g., such as an eZFP comprised in a fusion protein of an epigenetic-modifying DNA-targeting system), such as eZFP_24 as described herein. In some embodiments, the eZFP targets a target site comprising the nucleotide sequence set forth in SEQ ID NO:1051, a contiguous portion thereof of at least 12 nt, or a complementary sequence of any of the foregoing. In some embodiments, the eZFP targets a target site comprising the nucleotide sequence set forth in SEQ ID NO:1051. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:RADNLTE(SEQ ID NO:858) F2:TSGSLVR (SEQ ID NO:859) F3:RKDNLKN(SEQ ID NO:860) F4:QSSSLVR(SEQ ID NO:861) F5:RSDKLVR(SEQ ID NO:862) F6:DSGNLRV(SEQ ID NO:863). In some embodiments, the eZFP comprises the amino acid sequence set forth in SEQ ID NO:715, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:715. In some embodiments, the eZFP is encoded by the nucleotide sequence set forth in SEQ ID NO:911, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:911.

In some embodiments, provided herein is an eZFP (e.g., such as an eZFP comprised in a fusion protein of an epigenetic-modifying DNA-targeting system), such as eZFP_25 as described herein. In some embodiments, the eZFP targets a target site comprising the nucleotide sequence set forth in SEQ ID NO:1052, a contiguous portion thereof of at least 12 nt, or a complementary sequence of any of the foregoing. In some embodiments, the eZFP targets a target site comprising the nucleotide sequence set forth in SEQ ID NO:1052. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:QSSSLVR(SEQ ID NO:864) F2:QSGDLRR (SEQ ID NO:865) F3:RSDERKR(SEQ ID NO:866) F4:HRTTLTN(SEQ ID NO:867) F5:RSDHLTN(SEQ ID NO:868) F6:TSGELVR(SEQ ID NO:869). In some embodiments, the eZFP comprises the amino acid sequence set forth in SEQ ID NO:716, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:716. In some embodiments, the eZFP is encoded by the nucleotide sequence set forth in SEQ ID NO:912, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:912.

In some embodiments, provided herein is an eZFP (e.g., such as an eZFP comprised in a fusion protein of an epigenetic-modifying DNA-targeting system), such as eZFP_26 as described herein. In some embodiments, the eZFP targets a target site comprising the nucleotide sequence set forth in SEQ ID NO:1053, a contiguous portion thereof of at least 12 nt, or a complementary sequence of any of the foregoing. In some embodiments, the eZFP targets a target site comprising the nucleotide sequence set forth in SEQ ID NO:1053. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:QSGDLRR(SEQ ID NO:870) F2:RSDERKR (SEQ ID NO:871) F3:HRTTLTN(SEQ ID NO:872) F4:RSDHLTN(SEQ ID NO:873) F5:TSGELVR(SEQ ID NO:874) F6:RSDDLVR(SEQ ID NO:875). In some embodiments, the eZFP comprises the amino acid sequence set forth in SEQ ID NO:717, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:717. In some embodiments, the eZFP is encoded by the nucleotide sequence set forth in SEQ ID NO:913, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:913.

In some embodiments, provided herein is an eZFP (e.g., such as an eZFP comprised in a fusion protein of an epigenetic-modifying DNA-targeting system), such as eZFP_27 as described herein. In some embodiments, the eZFP targets a target site comprising the nucleotide sequence set forth in SEQ ID NO:1054, a contiguous portion thereof of at least 12 nt, or a complementary sequence of any of the foregoing. In some embodiments, the eZFP targets a target site comprising the nucleotide sequence set forth in SEQ ID NO:1054. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:QRAHLER(SEQ ID NO:876) F2:QLAHLRA (SEQ ID NO:877) F3:DPGHLVR(SEQ ID NO:878) F4:RR-SACRR(SEQ ID NO:879) F5:RSDHLTT(SEQ ID NO:880) F6:QSSSLVR(SEQ ID NO:881). In some embodiments, the eZFP comprises the amino acid sequence set forth in SEQ ID NO:718, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:718. In some embodiments, the eZFP is encoded by the nucleotide sequence set forth in SEQ ID NO:914, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:914.

In some embodiments, provided herein is an eZFP (e.g., such as an eZFP comprised in a fusion protein of an epigenetic-modifying DNA-targeting system), such as eZFP_28 as described herein. In some embodiments, the eZFP targets a target site comprising the nucleotide sequence set forth in SEQ ID NO:1055, a contiguous portion thereof of at least 12 nt, or a complementary sequence of any of the foregoing. In some embodiments, the eZFP targets a target site comprising the nucleotide sequence set forth in SEQ ID NO:1055. In some embodiments, the eZFP comprises six zinc fingers denoted F1 through F6 in order from N-terminus to C-terminus, each comprising a corresponding zinc finger recognition region F1 through F6, and the amino acid sequence of each zinc finger recognition region is as follows: F1:QSSNLVR(SEQ ID NO:882) F2:RSDDLVR (SEQ ID NO:883) F3:THLDLIR(SEQ ID NO:884) F4:TSGNLTE(SEQ ID NO:885) F5:RRSACRR(SEQ ID NO:886) F6:RNDTLTE(SEQ ID NO:887). In some embodiments, the eZFP comprises the amino acid sequence set forth in SEQ ID NO:719, or a portion thereof, or an amino acid sequence that has at least 90%, 91%, 92%, 93%, 94%, 95%, 96%, 97%, 98%, or 99% sequence identity thereto. In some embodiments, the eZFP comprises the amino acid sequence set forth in SEQ ID NO:719. In some embodiments, the eZFP is encoded by the nucleotide sequence set forth in SEQ ID NO:915, or a nucleotide sequence that has at least 90%, 91%, 92%, 93%, 94%, 95%, 96%, 97%, 98%, or 99% sequence identity thereto. In some embodiments, the eZFP is encoded by the nucleotide sequence set forth in SEQ ID NO:915.

D. Other DNA-Binding Domains

In some of any of the provided embodiments, the DNA-binding domain comprises a transcription activator-like effector (TALE); a meganuclease; a homing endonuclease; or an I-SceI enzyme or a variant thereof. In some embodiments, the DNA-binding domain comprises a catalytically inactive variant of any of the foregoing.

Transcription activator-like effectors (TALEs), are proteins naturally found in *Xanthomonas* bacteria. TALEs comprise a plurality of repeated amino acid sequences, each repeat having binding specificity for one base in a target sequence. Each repeat comprises a pair of variable residues in position 12 and 13 (repeat variable diresidue; RVD) that determine the nucleotide specificity of the repeat. In some embodiments, RVDs associated with recognition of the different nucleotides are HD for recognizing C, NG for recognizing T, NI for recognizing A, NN for recognizing G or A, NS for recognizing A, C, G or T, HG for recognizing T, IG for recognizing T, NK for recognizing G, HA for recognizing C, ND for recognizing C, HI for recognizing C, HN for recognizing G, NA for recognizing G, SN for recognizing G or A and YG for recognizing T, TL for recognizing A, VT for recognizing A or G and SW for recognizing A. In some embodiments, RVDs can be mutated towards other amino acid residues in order to modulate their specificity towards nucleotides A, T, C and G and in particular to enhance this specificity. Binding domains with similar modular base-per-base nucleic acid binding properties can also be derived from different bacterial species. These alternative modular proteins may exhibit more sequence variability than TALE repeats.

In some embodiments, a "TALE DNA binding domain" or "TALE" is a polypeptide comprising one or more TALE repeat domains/units. The repeat domains, each comprising a repeat variable diresidue (RVD), are involved in binding of the TALE to its cognate target DNA sequence. A single "repeat unit" (also referred to as a "repeat") is typically 33-35 amino acids in length and exhibits at least some sequence homology with other TALE repeat sequences within a naturally occurring TALE protein. TALE proteins may be designed to bind to a target site using canonical or non-canonical RVDs within the repeat units. See, e.g., U.S. Pat. Nos. 8,586,526 and 9,458,205.

In some embodiments, a TALE is a fusion protein comprising a nucleic acid binding domain derived from a TALE and an effector domain. In some embodiments, one or more sites in the FXN locus can be targeted by engineered TALEs.

Zinc finger and TALE DNA-binding domains can be engineered to bind to a predetermined nucleotide sequence, for example via engineering (altering one or more amino acids) of the recognition helix region of a naturally occurring zinc finger protein, by engineering of the amino acids in a TALE repeat involved in DNA binding (the repeat variable diresidue or RVD region), or by systematic ordering of modular DNA-binding domains, such as TALE repeats or ZFP domains. Therefore, engineered zinc finger proteins or TALE proteins are proteins that are non-naturally occurring. Non-limiting examples of methods for engineering zinc finger proteins and TALEs are design and selection. A designed protein is a protein not occurring in nature whose design/composition results principally from rational criteria. Rational criteria for design include application of substitution rules and computerized algorithms for processing information in a database storing information of existing ZFP or TALE designs (canonical and non-canonical RVDs) and binding data. See, for example, U.S. Pat. Nos. 9,458,205; 8,586,526; 6,140,081; 6,453,242; and 6,534,261; see also WO 98/53058; WO 98/53059; WO 98/53060; WO 02/016536 and WO 03/016496.

E. Effector Domains

In some aspects, the DNA-targeting systems provided herein include one or more effector domains. In some embodiments, provided herein is a DNA-targeting system comprising a fusion protein comprising: (a) a DNA-binding domain for targeting to a target site in a Hepatitis B viral DNA sequence, such as a gene or regulatory element thereof, for example any described above, and (b) at least one effector domain. In some aspects, the effector domain is capable of reducing transcription of the gene, i.e. comprises a transcriptional repressor effector domain. In some aspects, the effector domain comprises a transcription repressor effector domain.

In some aspects, the effector domain, represses, induces, catalyzes, or leads to reduced transcription of a gene and/or regulatory element thereof when ectopically recruited to the gene or DNA regulatory element thereof.

In some embodiments, the effector domain induces, catalyzes or leads to transcription repression, transcription co-repression, transcription repression, transcription factor release, polymerization, histone modification, histone acetylation, histone deacetylation, nucleosome remodeling, chromatin remodeling, heterochromatin formation, proteolysis, ubiquitination, deubiquitination, phosphorylation, dephosphorylation, splicing, nucleic acid association, DNA methylation, DNA demethylation, histone methylation, histone demethylation, or DNA base oxidation. In some embodiments, the effector domain represses, induces, catalyzes or leads to transcription repression or transcription co-repression. In some embodiments, the effector domain induces transcription repression. In some embodiments, the effector domain has one of the aforementioned activities itself (i.e. acts directly). In some embodiments, the effector domain recruits and/or interacts with a polypeptide domain that has one of the aforementioned activities (i.e. acts indirectly).

Gene expression of endogenous mammalian genes, such as human genes, can be achieved by targeting a fusion protein comprising a DNA-binding domain, such as a dCas9, and an effector domain to mammalian genes or regulatory DNA elements thereof (e.g. a promoter or enhancer) via one or more gRNAs. Any of a variety of effector domains are known and can be used in accord with the provided embodiments. Repression of target genes and/ or regulatory element thereof by such effector domains as Cas fusion proteins with a variety of Cas molecules and the transcriptional repressor domains, are described, for example, in WO2021226077, WO2017180915, WO2014197748, WO2014093655, US20190127713, WO2013176772, Adli, M. Nat. Commun. 9, 1911 (2018), Urrutia, R. Genome Biol. 4, 231 (2003), Groner, A. C. et al. PLoS Genet. 6, e1000869 (2010), Liu, X. S. et al. Cell 167, 233-247.e17 (2016), and Lei, Y. et al. Nat. Commun. 8, 16026 (2017).

In some embodiments, the effector domain may comprise a KRAB domain, ERF repressor domain, MXI1 domain, SID4X domain, MAD-SID domain, a DNMT family protein domain (e.g. DNMT3A or DNMT3B), a fusion of one or more DNMT family proteins or domains thereof (e.g. DNMT3A/L, which comprises a fusion of DNMT3A and DNMT3L domains), EZH2 domain, LSD1, a SunTag domain, a partially or fully functional fragment or domain of any of the foregoing, or a combination of any of the foregoing. In some embodiments, the fusion protein may be dCas9-KRAB. In some embodiments, the fusion protein may be DNMT3A/L-dCas9-KRAB. In some embodiments, the fusion protein may be KRAB-dCas9-DNMT3A/L.

In some embodiments, the effector domain comprises a transcriptional repressor domain described in WO 2021/226077.

In some embodiments, the effector domain comprises a KRAB domain, or a variant thereof. The KRAB-containing zinc finger proteins make up the largest family of transcriptional repressors in mammals. The Kruppel associated box (KRAB) domain is a transcriptional repressor domain present in many zinc finger protein-based transcription factors. The KRAB domain comprises charged amino acids and can be divided into sub-domains A and B. The KRAB domain recruits corepressors KAP1 (KRAB-associated protein-1), epigenetic readers such as heterochromatin protein 1 (HP1), and other chromatin modulators to induce transcriptional repression through heterochromatin formation. KRAB-mediated gene repression is associated with loss of histone H3-acetylation and an increase in H3 lysine 9 trimethylation (H3K9me3) at the repressed gene promoters. KRAB domains, including in dCas fusion proteins, have been described, for example, in WO 2017/180915, WO 2014/197748, US 2019/0127713, WO 2013/176772, Urrutia R. et al. Genome Biol. 4, 231 (2003), Groner A. C. et al. PLoS Genet. 6, e1000869 (2010). In some embodiments, the effector domain comprises at least one KRAB domain or a variant thereof.

In some embodiments, the KRAB domain is set forth in SEQ ID NO: 590. In some embodiments, the effector domain comprises the sequence set forth in SEQ ID NO: 590, or a portion thereof, or an amino acid sequence that has at least 90%, 91%, 92%, 93%, 94%, 95%, 96%, 97%, 98%, or 99% sequence identity to any of the foregoing.

In some embodiments, the KRAB domain is set forth in SEQ ID NO: 669. In some embodiments, the effector domain comprises the sequence set forth in SEQ ID NO: 669, or a portion thereof, or an amino acid sequence that has at least 90%, 91%, 92%, 93%, 94%, 95%, 96%, 97%, 98%, or 99% sequence identity to any of the foregoing.

In some embodiments, the effector domain comprises at least one ERF repressor domain, or a variant thereof. ERF (ETS2 repressor factor) is a strong transcriptional repressor that comprises a conserved ets-DNA-binding domain, and represses transcription via a distinct domain at the carboxyl-terminus of the protein. ERF repressor domains, including in dCas fusion proteins, have been described, for example, in WO2017180915, WO2014197748, WO2013176772, Mavrothalassitis, G., Ghysdael, J. Proteins of the ETS family with transcriptional repressor activity. Oncogene 19, 6524-6532 (2000). In some embodiments, the effector domain comprises at least one ERF repressor domain or a variant thereof. An exemplary ERF repressor domain is set forth in SEQ ID NO:600. In some embodiments, the effector domain comprises the sequence set forth in SEQ ID NO: 600, or a portion thereof, or an amino acid sequence that has at least 90%, 91%, 92%, 93%, 94%, 95%, 96%, 97%, 98%, or 99% sequence identity to any of the foregoing.

In some embodiments, the effector domain comprises at least one MXI1 domain, or a variant thereof. The MXI1 domain functions by antagonizing the myc transcriptional activity by competing for binding to myc-associated factor x (MAX). MXI1 domains, including in dCas fusion proteins, have been described, for example, in WO2017180915, WO2014197748, US20190127713. In some embodiments, the effector domain comprises at least one MXI1 domain or a variant thereof. An exemplary MXI1 domain is set forth in SEQ ID NO: 601. In some embodiments, the effector domain comprises the sequence set forth in SEQ ID NO: 601, or a portion thereof, or an amino acid sequence that has at least 90%, 91%, 92%, 93%, 94%, 95%, 96%, 97%, 98%, or 99% sequence identity to any of the foregoing.

In some embodiments, the effector domain comprises at least one SID4X domain, or a variant thereof. The mSin3 interacting domain (SID) is present on different transcription repressor proteins. It interacts with the paired amphipathic alpha-helix 2 (PAH2) domain of mSin3, a transcriptional repressor domain that is attached to transcription repressor proteins such as the mSin3 A corepressor. A dCas9 molecule can be fused to four concatenated mSin3 interaction domains (SID4X). SID domains, including in dCas fusion proteins, have been described, for example, in WO2017180915, WO2014197748, WO2014093655. In some embodiments, the effector domain comprises at least one SID domain or a variant thereof. An exemplary SID domain is set forth in SEQ ID NO:602. In some embodiments, the effector domain comprises the sequence set forth in SEQ ID NO: 602, or a portion thereof, or an amino acid sequence that has at least 90%, 91%, 92%, 93%, 94%, 95%, 96%, 97%, 98%, or 99% sequence identity to any of the foregoing.

In some embodiments, the effector domain comprises at least one MAD domain, or a variant thereof. The MAD family proteins, Mad1, Mxi1, Mad3, and Mad4, belong to the basic helix-loop-helix-zipper class and contain a conserved N terminal region (termed Sin3 interaction domain (SID)) necessary for repressional activity. MAD-SID domains, including in dCas fusion proteins, have been described, for example, in WO2017180915, WO2014197748, WO2013176772. In some embodiments, the effector domain comprises at least one MAD-SID domain or a variant thereof. An exemplary MAD-SID domain is set forth in SEQ ID NO:603. In some embodiments, the effector domain comprises the sequence set forth in SEQ ID NO:603, or a portion thereof, or an amino acid sequence that has at least 90%, 91%, 92%, 93%, 94%, 95%, 96%, 97%, 98%, or 99% sequence identity to any of the foregoing.

In some embodiments, the effector domain is from a DNMT3 or is a portion or a functionally active variant thereof with DNA methyltransferase activity. The DNMT3A and DNMT3B are two DNA methyltransferases that catalyze de novo methylation, which depending on the site may be associated with transcriptional repression. DNMTs, such as DNMT3s, mediate transfer of a methyl group from the universal methyl donor, S-adenosyl-L-methionine (SAM), to the 5-position of cytosine residues. In some aspects, these DNMT3 DNA methyltransferases induce de novo methylation of a cytosine base to methylated 5-methylcytosine. DNMT3, including in dCas fusion proteins, have been described, for example, in US20190127713, Liu, X. S. et al. Cell 167, 233-247.e17 (2016), Lei, Y. et al. Nat. Commun. 8, 16026 (2017). DNMT3 proteins, such as DNMT3A and DNMT3B, contain an N-terminal part that is naturally involved in regulatory activity and targeting, and a C-terminal catalytic domain termed the MTase C5-type domain. In some embodiments, an effector domain in embodiments provided herein includes a catalytically active portion of a DNMT3A or a DNMT3B that contains a catalytically active C-terminal domain. In particular, isolated catalytic domains of DNMT3a and DNMT3b are catalytically active (see e.g. Gowher and Jeltsch (2002) J. Biol. Chem., 277:20409).

In some embodiments, the DNMT3 domain may be an effector domain of DNMT3A or DNMT3B that is catalytically active. In some embodiments, the effector domain may be the full-length of DNMT3A or DNMT3B or a catalytically active portion thereof. In some embodiments, the effector domain is a catalytically active portion that is less than the full-length sequence of DNMT3A or DNMT3B. In some embodiments, a catalytically active portion is a contiguous sequence of amino acids that confers DNA methyltransferase activity, such as by mediating methylation of a cytosine base to methylated 5-methylcytosine. In some embodiments, the contiguous sequence of amino acids is a contiguous C-terminal portion of a DNMT3 protein, such as DNMT3A, or DNMT3B, that is from 280 amino acids to 330 amino acids in length. In some embodiments, the contiguous portion is 280 amino acids, 290 amino acids, 300 amino acids, 310 amino acids, 320 amino acids, or 330 amino acids in length, or is a length of any value between any of the foregoing. In some embodiments, a catalytically active portion of a DNMT, such as a DNMT3, includes a SAM-dependent MTase C5-type domain. In some embodiments, the DNMT3 domain, such as a domain of DNMT3A or DNMT3B, is of human origin.

In some embodiments, the effector domain is from DNMT3A or a catalytically active portion or variant thereof. An exemplary DNMT3A domain is set forth in SEQ ID NO:604, or is a catalytically active portion thereof, or is an amino acid sequence that has at least 90%, 91%, 92%, 93%, 94%, 95%, 96%, 97%, 98%, or 99% sequence identity to SEQ ID NO:604 or the catalytically active portion thereof that exhibits DNA methyltransferase activity. In some embodiments, the catalytically active portion is a contiguous portion of amino acids of SEQ ID NO:604 that includes the SAM-dependent MTase C5-type domain (e.g. corresponding to amino acids 634-912 of SEQ ID NO:604. In some embodiments, the contiguous sequence of amino acids of SEQ ID NO: 604 includes at least 250 amino acids, 275 amino acids, 300 amino acids or 325 amino acids, or any value between any of the foregoing. In some embodiments, the contiguous sequence of amino acids is a contiguous portion of SEQ ID NO:604 that includes amino acids 634-912 and is from 280 amino acids to 330 amino acids in length. In some embodiments, the contiguous portion is 280 amino acids, 290 amino acids, 300 amino acids, 310 amino acids, 320 amino acids, or 330 amino acids in length, or is a length of any value between any of the foregoing.

In some embodiments, the DNMT3A domain is set forth in SEQ ID NO:661, or is a catalytically active portion thereof, or is an amino acid sequence that has at least 90%, 91%, 92%, 93%, 94%, 95%, 96%, 97%, 98%, or 99% sequence identity to SEQ ID NO:661 or the catalytically active portion thereof that exhibits DNA methyltransferase activity. In some embodiments, the DNMT3A domain is set forth in SEQ ID NO:661.

In some embodiments, the DNMT3A domain is set forth in SEQ ID NO:665, or is a catalytically active portion thereof, or is an amino acid sequence that has at least 90%, 91%, 92%, 93%, 94%, 95%, 96%, 97%, 98%, or 99% sequence identity to SEQ ID NO:665 or the catalytically active portion thereof that exhibits DNA methyltransferase activity. In some embodiments, the DNMT3A domain is set forth in SEQ ID NO:665.

In some embodiments, the effector domain is from DNMT3B or a catalytically active portion or variant thereof that exhibits DNA methyltransferase activity. An exemplary DNMT3B domain is set forth in SEQ ID NO:605, or is a catalytically active portion thereof, or is an amino acid sequence that has at least 90%, 91%, 92%, 93%, 94%, 95%, 96%, 97%, 98%, or 99% sequence identity to SEQ ID NO:605 or the catalytically active portion thereof that exhibits DNA methyltransferase activity. In some embodiments, the catalytically active portion is a contiguous portion of amino acids of SEQ ID NO:605 that includes the SAM-dependent MTase C5-type domain (e.g. corresponding to amino acids 575-853 of SEQ ID NO:605). In some embodiments, the contiguous sequence of amino acids of SEQ ID NO: 605 includes at least 250 amino acids, 275 amino acids, 300 amino acids or 325 amino acids, or any value between any of the foregoing. In some embodiments, the contiguous sequence of amino acids is a contiguous portion of SEQ ID NO:605 that includes amino acids 575-853 and is from 280 amino acids to 330 amino acids in length. In some embodiments, the contiguous portion is 280 amino acids, 290 amino acids, 300 amino acids, 310 amino acids, 320 amino acids, or 330 amino acids in length, or is a length of any value between any of the foregoing.

Any of a variety of assays are known to assess or monitor methyltransferase (MTase) ativity. In some embodiments, exemplary assays to assess DNA methyltransferase activity include, but are not limited to, radio DNA MTase assays, colorimetric DNA MTase activity assays, fluorescent DNA MTase activity assays, chemiluminescent/bioluminescent DNA MTase activity assays, electrochemical DNA MTase activity assays, and elctrogenerated chemiluminescence (ECL) DNA MTase activity assays. Exemplary assays are described in Poh et al. Theranostics, 2016, 6:369-391; Li et al., Methods Appl. Fluoresc., 2017, 5:012002; Deng et al., Anal Chem., 2014, 86:2117-23; and Ma et al. J Mater Chem B., 2020, 8:3488-3501.

In some embodiments, the effector domain includes a DNMT3L, or a portionor a variant of DNMT3L or the portion thereof. DNMT3L (DNA (cytosine-5)-methyltransferase 3-like) is a catalytically inactive regulatory factor of DNA methyltransferases that can either promote or inhibit DNA methylation depending on the context. DNMT3L is essential for the function of DNMT3A and DNMT3B; DNMT3L interacts with DNMT3A and DNMT3B and enhances their catalytic activity. For instance, DNMT3L interacts with the catalytic domain of DNMT3A or DNMT3B to form a heterodimer, demonstrating that DNMT3L has dual functions of binding an unmethylated histone tail and activating DNA methyltransferase. In some embodiments, reference to a portion or variant of a DNMT3L for purposes herein refers to a sufficient C-terminal sequence portion of DNMT3L that interacts with the catalytic domain of DNMT3A or DNMT3B and is able to stimulate or promote DNA methyltransferase activity of DNMT3A or DNMT3B (see e.g. Jia et al. Nature, 2007, 449:248-251; Gowher et al. J. Biol. Chem., 2005, 280: 13341-13348). In some embodiments, the DNMT3L or portion thereof is of animal origin. In some embodiments, the domain from DNMT3L is of murine origin. In some embodiments, the domain from DNMT3L is of human origin.

In some embodiments, the DNMT3L domain is a DNMT3L, or a C-terminal portion or variant thereof, that interacts with the catalytic domain of DNMT3A to form a heterodimer to provide for a more active DNA methyltransferase. In some embodiments, the effector domain is a fusion domain of a DNMT3A domain and the DNMT3L domain (DNMT3A/3L).

In some embodiments, the DNMT3L domain is a DNMT3L, or a C-terminal portion or variant thereof, that interacts with the catalytic domain of DNMT3B to form a heterodimer to provide for a more active DNA methyltransferase. In some embodiments, the effector domain is a fusion domain of a DNMT3B domain and the DNMT3L domain (DNMT3B/3L).

In some embodiments, the DNMT3L domain is a C-terminal portion of DNMT3L composed of a contiguous C-terminal portion of the full-length DNMT3L that does not include the N-terminal cysteine-rich ATRX-Dnmt3-Dnmt3L (ADD) domain (e.g. corresponding to residues 41-73 of SEQ ID NO: 607 or 75-207 of the sequence set forth in SEQ ID NO:668). In some embodiments, the DNMT3L domain is a contiguous C-terminal portion of DNMT3L that is less than 220 amino acids in length, such as between 100 and 215 amino acids, such as at or about 100, 110, 120, 130, 140, 150, 160, 170, 180, 190, 200, 210 or 215 amino acids in length, or a length between a value of any of the foregoing. In some embodiments, the DNMT3L domain is a contiguous C-terminal portion of DNMT3L that is 205, 206, 207, 208, 209, 210, 211, 212, 213, 214 or 215 amino acids in length.

An exemplary DNMT3L domain is set forth in SEQ ID NO:668, or is a portion thereof, or is an amino acid sequence that has at least 90%, 91%, 92%, 93%, 94%, 95%, 96%, 97%, 98%, or 99% sequence identity to SEQ ID NO:668 or the portion thereof. In some embodiments, the DNMT3L domain is a contiguous C-terminal portion of the full-length DNMT3L set forth in SEQ ID NO: 668 that does not include the N-terminal cysteine-rich ATRX-Dnmt3-Dnmt3L (ADD) domain (corresponding to residues 75-207 of the sequence set forth in SEQ ID NO:668). In some embodiments, the DNMT3L domain is a contiguous C-terminal portion of the full-length DNMT3L set forth in SEQ ID NO: 668 that is less than 220 amino acids in length, such as between 100 and 215 amino acids, such as at or about 100, 110, 120, 130, 140, 150, 160, 170, 180, 190, 200, 210 or 215 amino acids in length, or a length between a value of any of the foregoing. In some embodiments, the DNMT3L domain is a contiguous C-terminal portion of the full-length DNMT3L set forth in SEQ ID NO: 668 that is 205, 206, 207, 208, 209, 210, 211, 212, 213, 214 or 215 amino acids in length.

In some embodiments, the DNMT3L domain is set forth in SEQ ID NO:664, or is a portion thereof, or is an amino acid sequence that has at least 90%, 91%, 92%, 93%, 94%, 95%, 96%, 97%, 98%, or 99% sequence identity to SEQ ID NO:664. In some embodiments, the DNMT3L domain is set forth in SEQ ID NO:664. In some embodiments, the DNMT3L domain does not contain an N-terminal methionine, such as set forth in SEQ ID NO: 664.

In some embodiments, the DNMT3L domain is a human or humanized DNMT3L. Corresponding sequences of human are highly homologous to the Dnmt3L derived from mouse and have a sequence identity of at least 90% with the murine sequence. It is within the level of a skilled artisan to humanize a non-human sequence of a DNMT3L domain, such as a domain of a murine DNMT3L. In some embodiments, the effector domain includes a DNMT3L domain that is a humanized variant of the murine DMT3L set forth in SEQ ID NO:668 or a portion thereof that is able to interact with DNMT3A or DNMT3A. In some embodiments, the effector domain includes a DNMT3L domain that is a humanized variant of the murine C-terminal portion of DNMT3L set forth in SEQ ID NO:664.

An exemplary DNMT3L domain of human origin is set forth in SEQ ID NO:607, or is a portion thereof, or is an amino acid sequence that has at least 90%, 91%, 92%, 93%, 94%, 95%, 96%, 97%, 98%, or 99% sequence identity to SEQ ID NO:607 or the portion thereof. In some embodiments, the DNMT3L domain is a contiguous C-terminal portion of the full-length DNMT3L set forth in SEQ ID NO: 607 that does not include the N-terminal cysteine-rich ATRX-Dnmt3-Dnmt3L (ADD) domain (corresponding to residues 41-73 of the sequence set forth in SEQ ID NO:607). In some embodiments, the DNMT3L domain is a contiguous C-terminal portion of the full-length DNMT3L set forth in SEQ ID NO: 607 that is less than 220 amino acids in length, such as between 100 and 215 amino acids, such as at or about 100, 110, 120, 130, 140, 150, 160, 170, 180, 190, 200, 210 or 215 amino acids in length, or a length between a value of any of the foregoing. In some embodiments, the DNMT3L domain is a contiguous C-terminal portion of the full-length DNMT3L set forth in SEQ ID NO: 607 that is 205, 206, 207, 208, 209, 210, 211, 212, 213, 214 or 215 amino acids in length.

In some embodiments, the DNMT3L domain comprises the sequence set forth in SEQ ID NO:666, or is a portion thereof, or is an amino acid sequence that has at least 90%, 91%, 92%, 93%, 94%, 95%, 96%, 97%, 98%, or 99% sequence identity to SEQ ID NO:666. In some embodiments, the DNMT3L domain is set forth in SEQ ID NO:666. In some embodiments, the DNMT3L domain contains an N-terminal methionine.

In some embodiments, the effector domain comprises a fusion of DNMT3A and DNMT3L (DNMT3A/L). The fusion protein contains DNMT3A and DNMT3L domains that can be any as described above. In some embodiments, the fusion protein contains the DNMT3A domain set forth in SEQ ID NO: 661 and the DNMT3L domain set forth in SEQ ID NO: 668, arranged in any order. In some embodiments, the fusion protein contains the DNMT3A domain set forth in SEQ ID NO: 661 and the DNMT3L domain set forth in SEQ ID NO:664, arranged in any order. In some embodiments, the fusion protein contains the DNMT3A domain set forth in SEQ ID NO:661 and the DNMT3L domain set forth in SEQ ID NO:666, arranged in any order. In some embodiments, the fusion protein contains the DNMT3A domain set forth in SEQ ID NO: 665 and the DNMT3L domain set forth in SEQ ID NO: 668, arranged in any order. In some embodiments, the fusion protein contains the DNMT3A domain set forth in SEQ ID NO: 665 and the DNMT3L domain set forth in SEQ ID NO:664, arranged in any order. In some embodiments, the fusion protein contains the DNMT3A domain set forth in SEQ ID NO:665 and the DNMT3L domain set forth in SEQ ID NO:666, arranged in any order. In some embodiments, the DNMT3A and DNMT3L domains present in a provided fusion protein are separated from each other in the fusion protein by an intervening sequence, such as the DNA-binding domain, another effector domain or a linker. In some embodiments, the domains are either directly linked to each other or they are linked via a linker, such as a peptide linker. In some embodiments, the DNMT3A and DNMT3L domains are connected as a fusion domain via a linker that connects the DNMT3A domain and the DNMT3L domain. Exemplary linkers are described herein. In some embodiments, the linker is the linker set forth in SEQ ID NO: 667.

An exemplary DNMT3A/L fusion domain is set forth in SEQ ID NO:651. In some embodiments, the effector domain comprises the sequence set forth in SEQ ID NO:651, or an amino acid sequence that has at least 90%, 91%, 92%, 93%, 94%, 95%, 96%, 97%, 98%, or 99% sequence identity to SEQ ID NO:651 and exhibits DNA methyltransferase activity.

In some embodiments, the effector domain may comprise a LSD1 domain. LSD1 (also known as Lysine-specific histone demethylase 1A) is a histone demethylase that can demethylate lysine residues of histone H3, thereby acting as a coactivator or a corepressor, depending on the context. LSD1, including in dCas fusion proteins, has been described, for example, in WO 2013/176772, WO 2014/152432, and Kearns, N. A. et al. Nat. Methods. 12(5):401-403 (2015). An exemplary LSD1 polypeptide is set forth in SEQ ID NO:606. In some embodiments, the effector domain comprises the sequence set forth in SEQ ID NO:606, or a portion thereof, or an amino acid sequence that has at least 90%, 91%, 92%, 93%, 94%, 95%, 96%, 97%, 98%, or 99% sequence identity to any of the foregoing.

In some embodiments, the effector domain may comprise an EZH2 domain. EZH2 (also known as Histone-lysine N-methyltransferase EZH2) is a Catalytic subunit of the PRC2/EED-EZH2 complex, which methylates 'Lys-9' (H3K9me) and 'Lys-27' (H3K27me) of histone H3, in some aspects leading to transcriptional repression of the affected target gene. EZH2, including in dCas fusion proteins, has been described, for example, in O'Geen, H. et al., Epigenetics Chromatin. 12(1):26 (2019). An exemplary EZH2 polypeptide is set forth in SEQ ID NO:608. In some embodiments, the effector domain comprises the sequence set forth in SEQ ID NO:608, or a portion thereof, or an amino acid sequence that has at least 90%, 91%, 92%, 93%, 94%, 95%, 96%, 97%, 98%, or 99% sequence identity to any of the foregoing.

In some embodiments, the effector domain may comprise a SunTag domain. SunTag is a repeating peptide array, which can recruit multiple copies of an antibody-fusion protein that binds the repeating peptide. The antibody-fusion protein may comprise an additional effector domain, such as a transcription repression domain (e.g. KRAB), to reduce transcription of the target gene. SunTag, including in dCas fusion proteins for gene modulation have been described, for example, in WO 2016/011070 and Tanenbaum, M. et al. Cell. 159(3):635-646 (2014). An exemplary SunTag effector domain includes a repeating GCN4 peptide having the amino acid sequence LLPKNYHLENEVARLKKLVGER (SEQ ID NO: 641) separated by linkers having the amino acid sequence GGSGG (SEQ ID NO: 642). In some embodiments, the effector domain comprises at least one copy of the sequence set forth in SEQ ID NO: 641, or a portion thereof, or an amino acid sequence that has at least 90%, 91%, 92%, 93%, 94%, 95%, 96%, 97%, 98%, or 99% sequence identity to any of the foregoing. In some embodiments, the SunTag effector domain recruits an antibody-fusion protein that comprises KRAB and binds the GCN4 peptide.

In some embodiments, the epigenetic-modifying DNA-targeting system comprises at least one effector domain comprising a DNA methyltransferase (e.g., DNMT3A or DNMT3B). In some embodiments, the epigenetic-modifying DNA-targeting system comprises at least one effector domain comprising a repressor domain (e.g., KRAB). In some emdodiments, the epigenetic-modifying DNA-targeting system comprising at least one effector domain comprises a DNA methyltransferase and a histone methyltransferase (e.g., DNMT3A-KRAB or DNMT3A/L-KRAB).

F. Fusion Proteins

In some aspects, the DNA-targeting systems provided herein include fusion proteins. In some embodiments, provided herein is a DNA-targeting system comprising at least one DNA-targeting module, in which each of the at least one DNA-targeting module comprises a fusion protein comprising: (a) a DNA-binding domain for targeting to a target site in a Hepatitis B viral DNA sequence, such as a gene or regulatory element thereof, for example any as described herein, and (b) at least one transcriptional repressor effector domain. In some aspects, the fusion protein comprises at least one of any of the DNA-binding domains described herein, and at least one of any of the effector domains described herein. For instance, in some embodiments, the fusion protein contains a CRISPR-Cas or variant thereof, such as described in Section I.B, and at least one transcriptional repressor effector domain, such as any described in Section I.E. In some aspects, the fusion protein is targeted to a target site in a gene or regulatory element thereof, and leads to reduced or repressed transcription of the gene.

In some embodiments, the DNA-binding domain and effector domain of the fusion protein are heterologous, i.e. the domains are from different species, or at least one of the domains is not found in nature. In some aspects, the fusion protein is an engineered fusion protein, i.e. the fusion protein is not found in nature.

In some embodiments, the at least one effector domain is fused to the N-terminus, the C-terminus, or both the N-terminus and the C-terminus, of the DNA-binding domain or a component thereof. In some embodiments, the at least one effector domain may be fused to the DNA-binding domain directly, or via any intervening amino acid sequence, such as a linker sequence or a nuclear localization sequence (NLS).

In some embodiments, the fusion protein of a provided DNA-binding system, or a DNA-targeting module thereof, comprises, from N- to C-terminal order: a transcriptional repressor effector domain and a DNA-binding domain. In some embodiments, the fusion protein of a provided DNA-binding system, or a DNA-targeting module thereof, comprises, from N- to C-terminal order: a DNA-binding domain and a transcriptional repressor effector domain.

In some embodiments, the at least one effector domain of the fusion protein includes more than one effector domains. In some embodiments, the fusion protein includes 2, 3 or 4 effector domains. In some embodiments, at least two of the effector domains of the fusion protein are different. In some embodiments, each of the effector domains of the fusion protein are different. In some embodiments, the at least one effector domain includes two effector domains in which the two effector domains are different. In some embodiments, the effector domains and the DNA-binding domain can be arranged in any order.

In some embodiments, the at least one effector domain of the fusion protein includes two different effector domains. The two different effector domains and the DNA-binding domain can be arranged in any order. In some embodiments, each of the effector domains are N-terminal to the DNA-binding domain in which a first effector domain is fused to the N-terminus of the second effector domain and the second effector domain is fused to the N-terminus of the DNA-binding domain. In some embodiments, the fusion protein of a provided DNA-binding system, or a DNA-targeting module thereof, comprises from N- to C-terminal order: a first transcriptional repressor effector domain, a second transcriptional repressor effector domain and the DNA binding domain. In some embodiments, each of the effector domains are C-terminal to the DNA-binding domain in which a first effector domain is fused to the C-terminus of the DNA-binding domain and the second effector domain is fused to the C-terminus of the first effector domain. In some embodiments, the fusion protein of a provided DNA-binding system, or a DNA-targeting module thereof, comprises from N- to C-terminal order: a DNA-binding domain, a first transcriptional repressor effector domain, and a second transcriptional repressor effector domain. In some embodiments, the DNA-binding domain is between the effector domains, in which one effector domain is fused to the N-terminus of the DNA-binding domain and the other effector domain is fused to the C-terminus of the DNA-binding domain. In some embodiments, the fusion protein of a provided DNA-binding system, or a DNA-targeting module thereof, comprises from N- to C-terminal order: a first transcriptional effector domain, a DNA-binding domain, and a second transcriptional repressor effector domain. In some embodiments, one or more of the components may be fused to eachother directly, or via any intervening amino acid sequence, such as via a linker sequence or a nuclear localization sequence (NLS).

In some embodiments, the fusion protein comprises one or more linkers. In some embodiments, the one or more linkers connect the DNA-binding domain or a component thereof to at least one effector domain of the fusion protein. A linker may be included anywhere in the polypeptide sequence of the fusion protein, for example, between the effector domain and the DNA-binding domain or a component thereof. In some embodiments, the one or more linkers connect two effector domains of the fusion protein. Depending on the number of effector domains, the fusion protein can include 1, 2, 3, 4 or more linkers. In some embodiments, the linkers may be the same or they may be different.

A linker may be of any length and designed to promote or restrict the mobility of components in the fusion protein. In some embodiments, the linker is a peptide linker. A linker may comprise any amino acid sequence of about 2 to about 100, about 5 to about 80, about 10 to about 60, or about 20 to about 50 amino acids. A linker may comprise an amino acid sequence of at least about 2, 3, 4, 5, 10, 15, 20, 25, 30, 35, 40, 45, 50, 55, 60, 65, 70, 75, 80 or 85 amino acids. A linker may comprise an amino acid sequence of less than about 100, 90, 80, 70, 60, 50, or 40 amino acids. A skilled artisan can readily choose an appropriate linker for the connection of two domains. In some embodiments, the linker is a flexible linker. Flexible linkers are generally composed of small, non-polar or polar residues such as glycine, serine or threonine. In some embodiments, the linker is the Gly$_4$Ser(fy linker, whereby n is an integer of 1 to 10. A linker may include sequential or tandem repeats of an amino acid sequence that is 2 to 20 amino acids in length. Linkers may be rich in amino acids glycine (G), serine (S), and/or alanine (A). Linkers may include, for example, a GS linker. An exemplary GS linker is represented by the sequence GGGGS (SEQ ID NO: 609), or the formula (GGGGS)n, wherein n is an integer that represents the number of times the GGGGS sequence is repeated (e.g. between 1 and 10 times). The number of times a linker sequence is repeated can be adjusted to optimize the linker length and achieve appropriate separation of the functional domains. Other examples of linkers may include, for example, GGGGG (SEQ ID NO: 610), GGAGG (SEQ ID NO: 611), GGGGSSS (SEQ ID NO: 612), or GGGGAAA (SEQ ID NO: 613).

In some embodiments, artificial linker sequences can be used. In some embodiments, the linker is EASGSGRASP-GIPGSTR (SEQ ID NO: 672). In some embodiments, the linker is linker is GIHGVPAA (SEQ ID NO: 673). In some embodiments, the linker is SSGNSNAN-SRGPSFSSGLVPLSLRGSH (SEQ ID NO: 667). In some embodiments, the linker is KRPAATKKAGQAKKKKAS-DAKSLTAWS (SEQ ID NO: 677).

(SEQ ID NO: 677)
KRPAATKKAGQAKKKKASDAKSLTAWS.

In some embodiments, the linker is an XTEN linker. In some aspects, an XTEN linker is a recombinant polypeptide (e.g., an unstructured recombinant peptide) lacking hydrophobic amino acid residues. Exemplary XTEN linkers are described in, for example, Schellenberger et al., Nature Biotechnology 27, 1186-1190 (2009) or WO 2021/247570. In some embodiments, inclusion of a linker in the fusion protein leads to enhanced repression of the target gene. In some embodiments, a linker comprises the sequence set forth in SEQ ID NO:643, or a portion thereof, or an amino acid sequence that has at least 90%, 91%, 92%, 93%, 94%, 95%, 96%, 97%, 98%, or 99% sequence identity to any of the foregoing. In some aspects, the linker comprises the sequence set forth in SEQ ID NO:643, or a contiguous portion of SEQ ID NO:643 of at least 5, 10, 15, 20, 25, 30, 35, 40, 45, 50, 55, 60, 65, 70 or 75 amino acids. In some aspects, the linker consists of the sequence set forth in SEQ ID NO:643, or a contiguous portion of SEQ ID NO:643 of at least 5, 10, 15, 20, 25, 30, 35, 40, 45, 50, 55, 60, 65, 70 or 75 amino acids. In some embodiments, the linker comprises the sequence set forth in SEQ ID NO:643. In some embodiments, the linker consist of the sequence set forth in SEQ ID NO:643. In some embodiments, a linker comprises the sequence set forth in SEQ ID NO:658, or a portion thereof, or an amino acid sequence that has at least 90%, 91%, 92%, 93%, 94%, 95%, 96%, 97%, 98%, or 99% sequence identity to any of the foregoing. In some aspects, the linker comprises the sequence set forth in SEQ ID NO:658, or a contiguous portion of SEQ ID NO:658 of at least 5, 10, or15 amino acids. In some aspects, the linker consists of the sequence set forth in SEQ ID NO:658, or a contiguous portion of SEQ ID NO:658 of at least 5, 10 or 15 amino acids. In some embodiments, the linker comprises the sequence set forth in SEQ ID NO:658. In some embodiments, the linker consist of the sequence set forth in SEQ ID NO:658. In some embodiments, a linker comprises a linker described in WO 2021/247570. Appropriate linkers may be selected or designed based rational criteria known in the art, for example as described in Chen et al. Adv. Drug Deliv. Rev. 65(10):1357-1369 (2013).

In some embodiments, a fusion protein of the DNA-targeting system, or a DNA-targeting module thereof, comprises one or more nuclear localization signals (NLS). In some embodiments, a fusion protein described herein comprises one or more nuclear localization sequences (NLSs), such as about or more than about 1, 2, 3, 4, 5, 6, 7, 8, 9, 10, or more NLSs. When more than one NLS is present, each may be selected independently of the others, such that a single NLS may be present in more than one copy and/or in combination with one or more other NLSs present in one or more copies. Non-limiting examples of NLSs include an NLS sequence derived from: the NLS of the SV40 virus large T-antigen, having the amino acid sequence PKKKRKV(SEQ ID NO: 614); the NLS from nucleoplasmin (e.g. the nucleoplasmin bipartite NLS with the sequence KRPAATKKAGQAKKKK (SEQ ID NO: 592); the c-myc NLS having the amino acid sequence PAAKRVKLD (SEQ ID NO: 615) or RQRRNELKRSP (SEQ ID NO: 616); the hRNPA1 M9 NLS having the sequence NQSSNFGPMKGGNFGGRSSGPYGGGGQYFAK-PRNQGGY (SEQ ID NO: 617); the sequence RMRIZFKNKGKDTAELRRRRVEVSVELRKAKKD-EQILKRRNV (SEQ ID NO: 618) of the IBB domain from importin-alpha; the sequences VSRKRPRP (SEQ ID NO: 619) and PPKKARED (SEQ ID NO: 620) of the myoma T protein; the sequence PQPKKKPL (SEQ ID NO: 621) of human p53; the sequence SALIKKKKKMAP (SEQ ID NO: 622) of mouse c-abl IV; the sequences DRLRR (SEQ ID NO: 623) and PKQKKRK (SEQ ID NO: 624) of the influenza virus NS1; the sequence RKLKKKIKKL (SEQ ID NO: 625) of the Hepatitis virus delta antigen; the sequence REKKKFLKRR (SEQ ID NO: 626) of the mouse Mx1 protein; the sequence KRKGDEVDGVDEVAKKKSKK (SEQ ID NO: 627) of the human poly(ADP-ribose) polymerase; and the sequence RKCLQAGMNLEARKTKK (SEQ ID NO: 628) of the steroid hormone receptors (human) glucocorticoid. In general, the one or more NLSs are of sufficient strength to drive accumulation of the fusion protein in a detectable amount in the nucleus of a eukaryotic cell. In general, strength of nuclear localization activity may derive from the number of NLSs in the fusion protein, the particular NLS(s) used, or a combination of these factors. Detection of accumulation in the nucleus may be performed by any suitable technique. For example, a detectable marker may be fused to the fusion protein, such that location within a cell may be visualized, such as in combination with a means for detecting the location of the nucleus (e.g. a stain specific for the nucleus such as DAPI). Cell nuclei may also be isolated from cells, the contents of which may then be analyzed by any suitable process for detecting protein, such as immunohistochemistry, Western blot, or enzyme activity assay. Accumulation in the nucleus may also be determined indirectly, such as by an assay for the effect of the fusion protein (e.g. an assay for altered gene expression activity in a cell transformed with the DNA-targeting system comprising the fusion protein), as compared to a control condition (e.g. an untransformed cell). In some embodiments, the NLS comprises the sequence set forth in SEQ ID NO: 592 (KRPAATKKAGQAKKKK), or a portion thereof.

In some embodiments, the NLS is linked to the N-terminus or the C-terminus of the DNA-binding domain via a linker. In some embodiments, the NLS is linked to the N-terminus or the C-terminus of an effector domain via a linker. The linker may be any linker as described above. In some embodiemnts, the linker is GIHGVPAA (SEQ ID NO: 673). In some embodiments, the NLS and linker has the sequence PKKKRKVGIHGVPAA (SEQ ID NO: 670).

In some configurations, the N- or C-terminus of the fusion protein can be linked to a moiety for detection and/or purification. In some aspects, the moiety is or includes a Flag tag DYKDDDDK (SEQ ID NO:671), a 3xFlag tag MDYKDHDGDYKDHDI DYKDDDDK (SEQ ID NO: 674, and HA tag YPYDVPDYA (SEQ TD NO: 675) or a His tag, such as HHHHHH (SEQ ID NO: 676).

1. Split Fusion Proteins

In some embodiments, the fusion protein is a split protein, i.e. comprises two or more separate polypeptide domains that interact or self-assemble to form a functional fusion protein. In some aspects, the split fusion protein comprises a dCas9 and an effector domain. In some aspects, the fusion protein comprises a split dCas9-effector domain fusion protein.

In some embodiments, the split fusion protein is assembled from separate polypeptide domains comprising trans-splicing inteins. Inteins are internal protein elements that self-excise from their host protein and catalyze ligation of flanking sequences with a peptide bond. In some embodiments, the split fusion protein is assembled from a first polypeptide comprising an N-terminal intein and a second polypeptide comprising a C-terminal intein. In some embodiments, the N terminal intein Is the N terminal Npu Intein set forth in SEQ ID NO:653. In some embodiments, the C terminal intein is the C terminal Npu intein set forth in SEQ ID NO:655. In some embodiments, the N terminal intein is the N terminal Npu Intein set forth in SEQ ID NO:652. In some embodiments, the C terminal intein is the C terminal Npu intein set forth in SEQ ID NO:654.

In some embodiments, the split fusion protein comprises a split dCas9-effector domain fusion protein assembled from two polypeptides. In an exemplary embodiment, the first polypeptide comprises an effector domain catalytic domain and an N-terminal fragment of dSpCas9, followed by an N terminal Npu Intein (effector domain-dSpCas9-573N), and the second polypeptide comprises a C terminal Npu Intein, followed by a C-terminal fragment of dSpCas9 (dSpCas9-573C; SEQ ID NO: 657). The N- and C-terminal fragments of the fusion protein are split at position 573Glu of the dSpCas9 molecule, with reference to SEQ ID NO: 598 (corresponding to residue 572Glu of the dSpCas9 molecule set forth in SEQ ID NO: 599). In some aspects, the N-terminal Npu Intein (SEQ ID NO:653) and C-terminal Npu Intein (set forth in SEQ ID NO:655) may self-excise and ligate the two fragments, thereby forming the full-length dSpCas9-effector domain fusion protein when expressed in a cell.

In some embodiments, the polypeptides of a split protein may interact non-covalently to form a complex that recapitulates the activity of the non-split protein. For example, two domains of a Cas enzyme expressed as separate polypeptides may be recruited by a gRNA to form a ternary complex that recapitulates the activity of the full-length Cas enzyme in complex with the gRNA, for example as described in Wright et al. PNAS 112(10):2984-2989 (2015). In some embodiments, assembly of the split protein is inducible (e.g. light inducible, chemically inducible, small-molecule inducible).

In some aspects, the two polypeptides of a split fusion protein may be delivered and/or expressed from separate vectors, such as any of the vectors described herein. In some embodiments, the two polypeptides of a split fusion protein may be delivered to a cell and/or expressed from two separate AAV vectors, i.e. using a split AAV-based approach, for example as described in WO 2017/197238.

Approaches for the rationale design of split proteins and their delivery, including Cas proteins and fusions thereof, are described, for example, in WO 2016/114972, WO 2017/197238, Zetsche. et al. Nat. Biotechnol. 33(2):139-42 (2015), Wright et al. PNAS 112(10):2984-2989 (2015), Truong. et al. Nucleic Acids Res. 43, 6450-6458 (2015), and Fine et al. Sci. Rep. 5, 10777 (2015).

2 Exemplary CRISPR-Based Fusion Proteins

In some embodiments, fusion proteins of provided DNA-targeting systems, or DNA-targeting modules thereof, are composed of a DNA-binding domain targeting to a target site in a Hepatitis B viral DNA sequence, such as a gene or regulatory element thereof, and at least one transcriptional repressor effector domain. The DNA-binding domain and transcriptional repressor domain include any as described above. Exemplary fusion proteins are further described below.

In some embodiments, a fusion protein named herein comprises elements of the named fusion protein in any configuration or order. For example, a dCas9-KRAB fusion protein may comprise a KRAB domain fused to the N- or C-terminus of a dSpCas9 molecule. In another example, a dSpCas9-KRAB-DNMT3A/L fusion protein may comprise dSpCas9, KRAB, and DNMT3A/L in any order. For example, a dSpCas9-KRAB-DNMT3A/L fusion protein may comprise from N-terminal to C-terminal, DNMT3A/L, dSpCas9, and KRAB. A fusion protein named herein may comprise additional elements. For example, a dSpCas9-KRAB-DNMT3A/L fusion protein may comprise one or more linkers, NLS sequences, or other sequences in any combination or order.

In some embodiments, the fusion protein of the DNA-targeting system, or a DNA-targeting module thereof, contains a dSpCas9 set forth in SEQ ID NO:599 and an ERF domain set forth in SEQ ID NO:600. In some embodiments, the fusion protein of the DNA-targeting system, or a DNA-targeting module thereof, contains a dSpCas9 set forth in SEQ ID NO:599 and a MXI1 domain set forth in SEQ ID NO:601. In some embodiments, the fusion protein of the DNA-targeting system, or a DNA-targeting module thereof, contains a dSpCas9 set forth in SEQ ID NO: 599 and a SID4X domain set forth in SEQ ID NO:602. In some embodiments, the fusion protein of the DNA-targeting system, or a DNA-targeting module thereof, contains a dSpCas9 set forth in SEQ ID NO:599 and a MAD-SID domain set forth in SEQ ID NO:603. In some embodiments, the fusion protein of the DNA-targeting system, or a DNA-targeting module thereof, contains a dSpCas9 set forth in SEQ ID NO:599 and a DNMT3A domain set forth in SEQ ID NO:604. In some embodiments, the fusion protein of the DNA-targeting system, or a DNA-targeting module thereof, contains a dSpCas9 set forth in SEQ ID NO:599 and a DNMT3A domain set forth in SEQ ID NO:661. In some embodiments, the fusion protein of the DNA-targeting system, or a DNA-targeting module thereof, contains a dSpCas9 set forth in SEQ ID NO:599 and a DNMT3A domain set forth in SEQ ID NO:665. In some embodiments, the fusion protein of the DNA-targeting system, or a DNA-targeting module thereof, contains a dSpCas9 set forth in SEQ ID NO:599 and a DNMT3B domain set forth in SEQ ID NO:605. In some embodiments, the fusion protein of the DNA-targeting system, or a DNA-targeting module thereof, contains a dSpCas9 set forth in SEQ ID NO:599 and a LSD1 domain set forth in SEQ ID NO:606. In some embodiments, the fusion protein of the DNA-targeting system, or a DNA-targeting module thereof, contains a dSpCas9 set forth in SEQ ID NO:599 and a DNMT3L domain set forth in SEQ ID NO:607. In some embodiments, the fusion protein of the DNA-targeting system, or a DNA-targeting module thereof, contains a dSpCas9 set forth in SEQ ID NO:599 and a EZH2 domain set forth in SEQ ID NO:608. In some embodiments, the fusion protein of the DNA-targeting system, or a DNA-targeting module thereof, contains a dSpCas9 set forth in SEQ ID NO:599 and a KRAB domain set forth in SEQ ID NO:590. In some embodiments, the fusion protein of the DNA-targeting system, or a DNA-targeting module thereof, contains a dSpCas9 set forth in SEQ ID NO:599 and a KRAB domain set forth in SEQ ID NO:669. In some embodiments, there is present a linker and/or NLS between the dSpCas9 and the effector domain. In some embodiments, a NLS may be present at the N-terminus or C-terminus of the fusion protein.

In some embodiments, a fusion protein of a DNA-targeting system, or a DNA-targeting module thereof, provided herein comprises a DNA-binding domain and a KRAB domain. In some embodiments, the DNA-binding domain is a catalytically inactive Cas enzyme (dCas). In some embodiments, the Cas is a dCas9, such as a dSaCas9 or a dSpCas9. In some embodiments, the DNA-binding domain is dSpCas9. In some embodiments, the DNA-binding domain is a dSpCas9 set forth in SEQ ID NO: 599 and the KRAB domain is set forth in SEQ ID NO:590. In some embodiments, the DNA-binding domain is a dSpCas9 set forth in SEQ ID NO: 599 and the KRAB domain is set forth in SEQ ID NO:669. In some embodiments, the fusion protein may include one or more linker or NLS, such as at the N- or C-terminus of the fusion protein or between the Cas and the KRAB domain. The linker or NLS can be any as described herein.

In some embodiments, the fusion protein of a DNA-targeting system, or a DNA-targeting module thereof, comprises, from N- to C-terminal order: NLS and/or a linker, dSpCas9 set forth in SEQ ID NO:599, a linker and/or NLS, and a KRAB domain set forth in SEQ ID NO:590. In some embodiments, the fusion protein of a DNA-targeting system, or a DNA-targeting module thereof, comprises, from N- to C-terminal order: NLS and/or a linker, dSpCas9 set forth in SEQ ID NO:599, a linker and/or NLS, and a KRAB domain set forth in SEQ ID NO:669.

In some embodiments, a fusion protein provided herein comprises NLS2-dSpCas9-NLS-KRAB-NLS2. In some embodiments, a fusion protein provided herein comprises the sequence set forth in SEQ ID NO: 595, or an amino acid sequence that has at least 90%, 91%, 92%, 93%, 94%, 95%, 96%, 97%, 98%, or 99% sequence identity thereto. In some embodiments, the fusion protein comprises the sequence set forth in SEQ ID NO:595.

In some embodiments, a fusion protein of a DNA-targeting system, or a DNA-targeting module thereof, provided herein comprises a DNA-binding domain, a DNMT3A domain and a DNMT3L domain. In some embodiments, the effector domains is a fusion domain of DNMT3A and DNMT3L (DNMT3A/L domain). In some embodiments, the DNA-binding domain is a catalytically inactive Cas enzyme (dCas). In some embodiments, the Cas is a dCas9, such as a dSaCas9 or a dSpCas9. In some embodiments, the DNA-binding domain is dSpCas9. In some embodiments, the DNA-binding domain is a dSpCas9 set forth in SEQ ID NO:599. In some embodiments, a linker or NLS connects one of the DNMT3A domain or the DNMT3L domain with the DNA-binding domain. In some embodiments, the DNA binding domain is a Cas, and a linker or NLS can be present between the Cas and one or both of the DNMT3A domain and DNMT3L domain. In some embodiments, a fusion protein contains a DNA-binding domain, a DNMT3A domain and a DNMT3L domain, in any order. In some embodiments, a linker connects a DNMT3A domain with a DNMT3L domain. In some embodiments, the DNMT3A domain an DNMT3B domain are connected as a fusion domain. In some embodiments, the fusion domain is the DNMT3A/L domain set forth in SEQ ID NO: 651.

In some embodiments, the DNA-targeting system or fusion protein comprises, from N- to C-terminal order: NLS and/or a linker, dSpCas9 set forth in SEQ ID NO:599, a linker and/or NLS, and a DNMT3A/L domain set forth in SEQ ID NO: 651. In some embodiments, the DNA-targeting system or fusion protein comprises, from N- to C-terminal order: NLS and/or a linker, dSpCas9 set forth in SEQ ID NO:599, a linker and/or NLS, and a DNMT3A/L domain set forth in SEQ ID NO:651, and a linker and/or NLS.

In some embodiments, a fusion protein of a DNA-targeting system, or a DNA-targeting module thereof, provided herein comprises a DNA-binding domain, and two effector domains in which one is a KRAB domain and the other is a DNMT3A domain and a DNMT3L domain. In some embodiments, the effector domain composed of the DNMT3A domain and the DNMT3L domain is a fusion domain of DNMT3A and DNMT3L (DNMT3A/L domain). In some embodiments, the DNA-binding domain is a catalytically inactive Cas enzyme (dCas). In some embodiments, the Cas is a dCas9, such as a dSaCas9 or a dSpCas9. In some embodiments, the DNA-binding domain is dSpCas9. In some embodiments, each of the KRAB domain, the DNMT3A domain and the DNMT3L domain are N-terminal to the DNA-binding domain. In some embodiments, each of the KRAB domain, the DNMT3A domain and the DNMT3L domain are C-terminal to the DNA-binding domain. In some embodiments, the DNA-binding domain is between the KRAB domain and one of the DNMT3A or DNMT3L domains. In some embodiments, the fusion domain is the DNMT3A/L domain set forth in SEQ ID NO: 651. In some embodiments, the KRAB domain is set forth in SEQ ID NO:590. In some embodiments, the KRAB domain is set forth in SEQ ID NO:669. In some embodiments, the DNA-binding domain is a dSpCas9 set forth in SEQ ID NO:599. In some embodiments, the fusion protein may include one or more linker or NLS, such as at the N- or C-terminus of the fusion protein or between the Cas and and the KRAB domain or DNMT3A/L domain. The linker or NLS can be any as described herein. In some embodiments, a linker or NLS can be present between the DNMT3A/L domain and the Cas. In some embodiments, a linker or NLS can be present between the Cas and the KRAB domain.

In some embodiments, the fusion protein contains the DNA-binding domain, and the KRAB domain and DNMT3A/3L fusion domain as first and second effector domains. In some embodiments, a first effector domain is fused to the N-terminus of the second effector domain and the second effector domain is fused to the N-terminus of the DNA-binding domain. In some embodiments, a fusion protein provided herein comprises in order: DNMT3A/L-KRAB-dSpCas9. In some embodiments, a fusion protein provided herein comprises in order: KRAB-DNMT3A/L-dSpCas9. In some embodiments, each of the KRAB domain and DNMT3A/3L domain are C-terminal to the DNA-binding domain in which a first effector domain is fused to the C-terminus of the DNA-binding domain and the second effector domain is fused to the C-terminus of the first effector domain. In some embodiments, a fusion protein provided herein comprises in order: dSpCas9-DNMT3A/L-KRAB. In some embodiments, a fusion protein provided herein comprises in order: dSpCas9-KRAB-DNMT3A/L. In some embodiments, the DNA-binding domain is between the KRAB domain and DNMT3A/3L domain, in which one effector domain is fused to the N-terminus of the DNA-binding domain and the other effector domain is fused to the C-terminus of the DNA-binding domain. In some embodiments, a fusion protein provided herein comprises in order: KRAB-dSpCas9-DNMT3A/L. In some embodiments, a fusion protein provided herein comprises in order: DNMT3A/L-dSpCas9-KRAB.

In some embodiments, the fusion protein of a DNA-targeting system, or a DNA-targeting module thereof, comprises, from N- to C-terminal order: a DNMT3A/L fusion domain set forth in SEQ ID NO: 651, an NLS and/or a linker, a dSpCas9 set forth in SEQ ID NO:599, a linker and/or NLS, and a KRAB domain set forth in SEQ ID NO:590. In some embodiments, the fusion protein of a DNA-targeting system, or a DNA-targeting module thereof, comprises, from N- to C-terminal order: a DNMT3A/L fusion domain set forth in SEQ ID NO: 651, an NLS and/or a linker, a dSpCas9 set forth in SEQ ID NO:599, a linker and/or NLS, and a KRAB domain set forth in SEQ ID NO:669.

In some embodiments, the DNA-targeting system or fusion protein comprises, from N- to C-terminal order: a DNMT3A/L fusion domain set forth in SEQ ID NO: 651, a first linker and/or NLS, a dSpCas9 set forth in SEQ ID NO:599, a second linker and/or NLS, and a KRAB domain set forth in SEQ ID NO: 590. In some embodiments, the DNA-targeting system or fusion protein comprises, from N- to C-terminal order: a DNMT3A/L fusion domain set forth in SEQ ID NO: 651, a first linker and/or NLS, a dSpCas9 set forth in SEQ ID NO:599, a second linker and/or NLS, and a KRAB domain set forth in SEQ ID NO: 669.

In some embodiments, the fusion protein of the DNA-targeting system, or a DNA-targeting module thereof, comprises the sequence set forth in SEQ ID NO:645, or an amino acid sequence that has at least 90%, 91%, 92%, 93%, 94%, 95%, 96%, 97%, 98%, or 99% sequence identity to SEQ ID NO:645. In some embodiments, the fusion protein comprises the sequence set forth in SEQ ID NO:645.

In some embodiments, the fusion protein of the DNA-targeting system, or a DNA-targeting module thereof, comprises the sequence set forth in SEQ ID NO: 647, or an amino acid sequence that has at least 90%, 91%, 92%, 93%, 94%, 95%, 96%, 97%, 98%, or 99% sequence identity thereto. In some embodiments, the fusion protein comprises the sequence set forth in SEQ ID NO:647.

In some embodiments, the fusion protein of the DNA-targeting system, or a DNA-targeting module thereof, comprises the sequence set forth in SEQ ID NO: 649, or an amino acid sequence that has at least 90%, 91%, 92%, 93%, 94%, 95%, 96%, 97%, 98%, or 99% sequence identity thereto. In some embodiments, the fusion protein comprises the sequence set forth in SEQ ID NO:649.

In some embodiments, the polynucleotide is an mRNA molecule that comprises a sequence encoding a DNMT3A/L-dCas9-KRAB fusion protein, such as the sequence set forth in SEQ ID NO:680, or a sequence having at least about 80%, 85%, 90%, 91%, 92%, 93%, 94%, 95%, 96%, 97%, 98%, 99%, or 100% sequence identity thereto. In some embodiments, the polynucleotide is set forth in SEQ ID NO:680.

In some aspects, exemplary linkers or NLS sequences can be any described herein. In some aspects, exemplary linkers or NLS sequences can be positioned in any order between the DNA-binding domain (e.g. dSpCas9) and one or more effector domains (e.g., KRAB and DNMT3A/L). In aspects of any of the above embodiments, the NLS can be any as described, such as set forth in Section E. In aspects of any of the above embodiments, the linker can be any as described, such as set forth in Section F.

3. eZFP Fusion Proteins

In some aspects, the DNA-targeting system comprises an eZFP fusion protein, such as any provided herein. In some aspects, provided are DNA-targeting systems comprising eZFP fusion proteins.

In some aspects, the provided hereineZFP fusion proteins, are for targeting or capable of being targeted to an HBV gene or regulatory element thereof. In some embodiments, the fusion protein comprises an eZFP (i.e. the fusion protein is an eZFP fusion protein), such as any of the eZFPs described herein, for example in Section I-C. In some embodiments, the fusion protein further comprises an epigenetic effector domain, such as any of the effector domains for transcriptional repression described herein, for example in Section I-E. In some embodiments, the fusion protein comprises at least one epigenetic effector domain that decreases expression of an HBV gene or regulatory element thereof. In some embodiments, the fusion protein comprises more than one effector domain. In some embodiments, the fusion protein comprises one or more additional elements, such as a nuclear localization signal (NLS) or linker, such as any of the NLSs or linkers described herein. In some aspects, the elements of the fusion protein may be arranged in any suitable order within the fusion protein, such as an order from N-terminus to C-terminus. In some aspects, the fusion proteins comprising eZFPs provided herein may facilitate decreased expression of an HBV gene or regulatory element thereof, for example in connection with compositions and methods for treating a disease or disorder associated with HBV infection, liver disease, or cancer.

In some aspects, the fusion protein comprising the eZFP binds to, or is capable of binding to, (i.e. targets), any of the target sites provided herein. In some embodiments, the fusion protein binds to the target site. In some embodiments, the fusion protein comprising the eZFP binds to the target site that the eZFP binds to in the absence of the other elements of the fusion protein. Thus, in some embodiments, the eZFP of the fusion protein facilitates target-specific binding of the fusion protein. In some aspects, the fusion protein targets to the target site targeted by any of the eZFPs described herein, such as in Section I-C. In some embodiments, the fusion protein targets a target site in Table 7. In some embodiments, the fusion protein targets a target site in Table E4. In some embodiments, the fusion protein targets a target site comprising the nucleotide sequence set forth in any one of SEQ ID NOS: 1028-1055, a contiguous portion thereof of at least 12 nt, or a complementary sequence of any of the foregoing. In some embodiments, the target site comprises the nucleotide sequence set forth in any one of SEQ ID NOS: 1028-1055. In some embodiments, the target site comprises the nucleotide sequence set forth in any one of SEQ ID NOS: 1045, 1046 or 1052, a contiguous portion thereof of at least 12 nt, or a complementary sequence of any of the foregoing. In some embodiments, the target site comprises the nucleotide sequence set forth in any one of SEQ ID NOS: 1045, 1046 or 1052.

In some aspects, the fusion protein comprises any of the eZFPs set forth in Table E4. In some aspects, the fusion protein comprises an eZFP comprising the recognition regions F1-F6 set forth for any of the eZFPs set forth in Table E4 (comprising SEQ ID NOs: 720-725, respectively; SEQ ID NOs: 726-731, respectively; SEQ ID NOs:732-737, respectively; SEQ ID NOs:738-743, respectively; SEQ ID NOs:744-749, respectively; SEQ ID NOs:750-755, respectively; SEQ ID NOs:756-761, respectively; SEQ ID NOs: 762-767, respectively; SEQ ID NOs:768-773, respectively; SEQ ID NOs:774-779, respectively; SEQ ID NOs:780-785, respectively; SEQ ID NOs:786-791, respectively; SEQ ID NOs:792-797, respectively; SEQ ID NOs:798-803, respectively; SEQ ID NOs:804-809, respectively; SEQ ID NOs: 810-815, respectively; SEQ ID NOs:816-821, respectively; SEQ ID NOs:822-827, respectively; SEQ ID NOs:828-833, respectively; SEQ ID NOs:834-839, respectively; SEQ ID NOs:840-845, respectively; SEQ ID NOs:846-851, respectively; SEQ ID NOs:852-857, respectively; SEQ ID NOs: 858-863, respectively; SEQ ID NOs: 864-869, respectively; SEQ ID NOs:870-875, respectively; SEQ ID NOs:876-881, respectively; or SEQ ID NOs:882-887, respectively). In some embodiments, the fusion protein comprises the amino acid sequence set forth in any one of SEQ ID NOS: 692-719, or a portion thereof, or an amino acid sequence that has at least 90%, 91%, 92%, 93%, 94%, 95%, 96%, 97%, 98%, or 99% sequence identity thereto. In some embodiments, the fusion protein comprises the amino acid sequence set forth in any one of SEQ ID NOS: 692-719. In some embodiments, the fusion protein comprises the amino acid sequence set forth in any one of SEQ ID NOS: 709, 710, 716, or a portion thereof, or an amino acid sequence that has at least 90%, 91%, 92%, 93%, 94%, 95%, 96%, 97%, 98%, or 99% sequence identity thereto. In some embodiments, the fusion protein comprises the amino acid sequence set forth in any one of SEQ ID NOS: 709, 710, or 716. In some embodiments, the eZFP of the fusion protein is encoded by the nucleotide sequence set forth in any one of SEQ ID NOS: 888-915, or a nucleotide sequence that has at least 90%, 91%, 92%, 93%, 94%, 95%, 96%, 97%, 98%, or 99% sequence identity thereto. In some embodiments, the eZFP of the fusion protein is encoded by the nucleotide sequence set forth in any one of SEQ ID NOS:888-915. In some embodiments, the eZFP of the fusion protein is encoded by the nucleotide sequence set forth in any one of SEQ ID NOS:905, 906, 912, or a nucleotide sequence that has at least 90%, 91%, 92%, 93%, 94%, 95%, 96%, 97%, 98%, or 99% sequence identity thereto. In some embodiments, the eZFP of the fusion protein is encoded by the nucleotide sequence set forth in any one of SEQ ID NOS: 905, 906, or 912.

In some aspects, provided herein is a fusion protein comprising an eZFP, such as any of the eZPFs described herein, for example in Table E4. In some embodiments, the fusion protein targets a target site comprising the nucleotide sequence set forth in any one of SEQ ID NOS: 1028-1055, a contiguous portion thereof of at least 12 nt, or a complementary sequence of any of the foregoing. In some embodiments, the fusion protein targets a target site comprising the nucleotide sequence set forth in any one of SEQ ID NOS: 1028-1055. In some embodiments, the eZFP of the fusion protein comprises six zinc fingers denoted F1 through F6 in order from N-terminus to C-terminus, each comprising a corresponding zinc finger recognition region F1 through F6, and the amino acid sequences of the recognition regions F1-F6 comprise: SEQ ID NOs: 720-725, respectively; SEQ ID NOs: 726-731, respectively; SEQ ID NOs:732-737, respectively; SEQ ID NOs:738-743, respectively; SEQ ID NOs:744-749, respectively; SEQ ID NOs:750-755, respectively; SEQ ID NOs:756-761, respectively; SEQ ID NOs: 762-767, respectively; SEQ ID NOs:768-773, respectively; SEQ ID NOs:774-779, respectively; SEQ ID NOs:780-785, respectively; SEQ ID NOs:786-791, respectively; SEQ ID NOs:792-797, respectively; SEQ ID NOs:798-803, respectively; SEQ ID NOs:804-809, respectively; SEQ ID NOs: 810-815, respectively; SEQ ID NOs:816-821, respectively; SEQ ID NOs:822-827, respectively; SEQ ID NOs:828-833, respectively; SEQ ID NOs:834-839, respectively; SEQ ID NOs:840-845, respectively; SEQ ID NOs:846-851, respectively; SEQ ID NOs:852-857, respectively; SEQ ID NOs: 858-863, respectively; SEQ ID NOs: 864-869, respectively; SEQ ID NOs:870-875, respectively; SEQ ID NOs:876-881, respectively; or SEQ ID NOs:882-887, respectively.

In some embodiments, the eZFP of the fusion protein comprises six zinc fingers denoted F1 through F6 in order from N-terminus to C-terminus, each comprising a corresponding zinc finger recognition region F1 through F6, and the amino acid sequences of the recognition regions F1-F6 comprise: F1:QSAHRKN(SEQ ID NO:822) F2:TSSNRKT (SEQ ID NO:823) F3:RSDNLSA(SEQ ID NO:824) F4:RNNDRKT(SEQ ID NO:825) F5:TSGSLSR(SEQ ID NO:826) F6:QAGHLAK(SEQ ID NO:827), respectively.

In some aspects, provided herein is a fusion protein comprising an eZFP, such as any of the eZPFs described herein, for example in Table E5. In some embodiments, the fusion protein comprises the amino acid sequence set forth in SEQ ID NOS:944-971, or a portion thereof, or an amino acid sequence that has at least 90%, 91%, 92%, 93%, 94%, 95%, 96%, 97%, 98%, or 99% sequence identity thereto. In some embodiments, the fusion protein comprises the amino acid sequence set forth in SEQ ID NO: 944-971. In some embodiments, the fusion protein is encoded by the nucleotide sequence set forth in SEQ ID NOS: 916-943, or a nucleotide sequence that has at least 90%, 91%, 92%, 93%, 94%, 95%, 96%, 97%, 98%, or 99% sequence identity thereto. In some embodiments, the fusion protein is encoded by the nucleotide sequence set forth in SEQ ID NO: 916-943.

In some aspects, provided herein is a fusion protein comprising an eZFP, such as any of the eZPFs described herein, for example in Table E5. In some embodiments, the fusion protein comprises the amino acid sequence set forth in SEQ ID NOS:961, 962, 968, or a portion thereof, or an amino acid sequence that has at least 90%, 91%, 92%, 93%, 94%, 95%, 96%, 97%, 98%, or 99% sequence identity thereto. In some embodiments, the fusion protein comprises the amino acid sequence set forth in SEQ ID NO: 961, 962, 968. In some embodiments, the fusion protein is encoded by the nucleotide sequence set forth in SEQ ID NOS: 933, 934, 940, or a nucleotide sequence that has at least 90%, 91%, 92%, 93%, 94%, 95%, 96%, 97%, 98%, or 99% sequence identity thereto. In some embodiments, the fusion protein is encoded by the nucleotide sequence set forth in SEQ ID NO: 933, 934, 940.

In some aspects, provided herein is a fusion protein comprising an eZFP, such as any of the eZPFs described herein, for example in Table E6. In some embodiments, the fusion protein comprises the amino acid sequence set forth in SEQ ID NOS:1000-1027, or a portion thereof, or an amino acid sequence that has at least 90%, 91%, 92%, 93%, 94%, 95%, 96%, 97%, 98%, or 99% sequence identity thereto. In some embodiments, the fusion protein comprises the amino acid sequence set forth in SEQ ID NO: 1000-1027. In some embodiments, the fusion protein is encoded by the nucleotide sequence set forth in SEQ ID NOS: 972-999, or a nucleotide sequence that has at least 90%, 91%, 92%, 93%, 94%, 95%, 96%, 97%, 98%, or 99% sequence identity thereto. In some embodiments, the fusion protein is encoded by the nucleotide sequence set forth in SEQ ID NO: 916-943.

In some aspects, provided herein is a fusion protein comprising an eZFP, such as any of the eZPFs described herein, for example in Table E6. In some embodiments, the fusion protein comprises the amino acid sequence set forth in SEQ ID NOS:1017, 1018, 1024, or a portion thereof, or an amino acid sequence that has at least 90%, 91%, 92%, 93%, 94%, 95%, 96%, 97%, 98%, or 99% sequence identity thereto. In some embodiments, the fusion protein comprises the amino acid sequence set forth in SEQ ID NO: 1017, 1018, 1024. In some embodiments, the fusion protein is encoded by the nucleotide sequence set forth in SEQ ID NOS: 989, 990, 996, or a nucleotide sequence that has at least 90%, 91%, 92%, 93%, 94%, 95%, 96%, 97%, 98%, or 99% sequence identity thereto. In some embodiments, the fusion protein is encoded by the nucleotide sequence set forth in SEQ ID NO: 989, 990, 996.

In some embodiments, the eZFP of the fusion protein comprises six zinc fingers denoted F1 through F6 in order from N-terminus to C-terminus, each comprising a corresponding zinc finger recognition region F1 through F6, and the amino acid sequences of the recognition regions F1-F6 comprise: F1:RSDHLSQ(SEQ ID NO:828) F2:ASSTRTK (SEQ ID NO:829) F3:RSDDLTR(SEQ ID NO:830) F4:QKSNLSS(SEQ ID NO:831) F5:QSANRTT(SEQ ID NO:832) F6:QNATRTK(SEQ ID NO:833), respectively.

In some embodiments, the eZFP of the fusion protein comprises six zinc fingers denoted F1 through F6 in order from N-terminus to C-terminus, each comprising a corresponding zinc finger recognition region F1 through F6, and the amino acid sequences of the recognition regions F1-F6 comprise: F1:QSSSLVR(SEQ ID NO:864) F2:QSGDLRR (SEQ ID NO:865) F3:RSDERKR(SEQ ID NO:866) F4:HRTTLTN(SEQ ID NO:867) F5:RSDHLTN(SEQ ID NO:868)F6:TSGELVR(SEQ ID NO:869), respectively.

In some embodiments, provided herein is a fusion protein comprising an eZFP, such as eZFP_18 as described herein. In some embodiments, the fusion protein targets a target site comprising the nucleotide sequence set forth in SEQ ID NO:1045, a contiguous portion thereof of at least 12 nt, or a complementary sequence of any of the foregoing. In some embodiments, the fusion protein targets a target site comprising the nucleotide sequence set forth in SEQ ID NO:1045. In some embodiments, the fusion protein comprises six zinc fingers denoted F1 through F6 in order from N-terminus to C-terminus, each comprising a corresponding zinc finger recognition region F1 through F6, and the amino acid sequence of each zinc finger recognition region is as follows: F1:QSAHRKN(SEQ ID NO:822) F2:TSSNRKT (SEQ ID NO:823) F3:RSDNLSA(SEQ ID NO:824) F4:RNNDRKT(SEQ ID NO:825) F5:TSGSLSR(SEQ ID NO:826) F6:QAGHLAK(SEQ ID NO:827). In some embodiments, the fusion protein comprises the amino acid sequence set forth in SEQ ID NO:709, or a portion thereof, or an amino acid sequence that has at least 90%, 91%, 92%, 93%, 94%, 95%, 96%, 97%, 98%, or 99% sequence identity thereto. In some embodiments, the fusion protein comprises the amino acid sequence set forth in SEQ ID NO:709. In some embodiments, the fusion protein is encoded by the nucleotide sequence set forth in SEQ ID NO:905, or a nucleotide sequence that has at least 90%, 91%, 92%, 93%, 94%, 95%, 96%, 97%, 98%, or 99% sequence identity thereto. In some embodiments, the fusion protein is encoded by the nucleotide sequence set forth in SEQ ID NO:905.

In some embodiments, provided herein is a fusion protein comprising an eZFP, such as eZFP_19 as described herein. In some embodiments, the fusion protein targets a target site comprising the nucleotide sequence set forth in SEQ ID NO:1046 a contiguous portion thereof of at least 12 nt, or a complementary sequence of any of the foregoing. In some embodiments, the fusion protein targets a target site comprising the nucleotide sequence set forth in SEQ ID NO:1046. In some embodiments, the fusion protein comprises six zinc fingers denoted F1 through F6 in order from N-terminus to C-terminus, each comprising a corresponding zinc finger recognition region F1 through F6, and the amino acid sequence of each zinc finger recognition region is as follows: F1:RSDHLSQ(SEQ ID NO:828) F2:ASSTRTK (SEQ ID NO:829) F3:RSDDLTR(SEQ ID NO:830) F4:QKSNLSS(SEQ ID NO:831) F5:QSANRTT(SEQ ID NO:832) F6:QNATRTK(SEQ ID NO:833). In some embodiments, the fusion protein comprises the amino acid sequence set forth in SEQ ID NO:710, or a portion thereof, or an amino acid sequence that has at least 90%, 91%, 92%, 93%, 94%, 95%, 96%, 97%, 98%, or 99% sequence identity thereto. In some embodiments, the fusion protein comprises the amino acid sequence set forth in SEQ ID NO:710. In some embodiments, the fusion protein is encoded by the nucleotide sequence set forth in SEQ ID NO:906, or a nucleotide sequence that has at least 90%, 91%, 92%, 93%, 94%, 95%, 96%, 97%, 98%, or 99% sequence identity thereto. In some embodiments, the fusion protein is encoded by the nucleotide sequence set forth in SEQ ID NO:906.

In some embodiments, provided herein is a fusion protein comprising an eZFP, such as eZFP_25 as described herein. In some embodiments, the fusion protein targets a target site comprising the nucleotide sequence set forth in SEQ ID NO:1052, a contiguous portion thereof of at least 12 nt, or a complementary sequence of any of the foregoing. In some embodiments, the fusion protein targets a target site comprising the nucleotide sequence set forth in SEQ ID NO:1052. In some embodiments, the fusion protein comprises six zinc fingers denoted F1 through F6 in order from N-terminus to C-terminus, each comprising a corresponding zinc finger recognition region F1 through F6, and the amino acid sequence of each zinc finger recognition region is as follows: F1:QSSSLVR(SEQ ID NO:864) F2:QSGDLRR (SEQ ID NO:865) F3:RSDERKR(SEQ ID NO:866) F4:HRTTLTN(SEQ ID NO:867) F5:RSDHLTN(SEQ ID NO:868) F6:TSGELVR(SEQ ID NO:869). In some embodiments, the fusion protein comprises the amino acid sequence set forth in SEQ ID NO:716, or a portion thereof, or an amino acid sequence that has at least 90%, 91%, 92%, 93%, 94%, 95%, 96%, 97%, 98%, or 99% sequence identity thereto. In some embodiments, the fusion protein comprises the amino acid sequence set forth in SEQ ID NO:716. In some embodiments, the fusion protein is encoded by the nucleotide sequence set forth in SEQ ID NO:912, or a nucleotide sequence that has at least 90%, 91%, 92%, 93%, 94%, 95%, 96%, 97%, 98%, or 99% sequence identity thereto. In some embodiments, the fusion protein is encoded by the nucleotide sequence set forth in SEQ ID NO:912.

In some aspects, the fusion protein further comprises one or more nuclear localization signal (NLS), such as any suitable NLS, for example SV40 NLS (SEQ ID NO: 614) or any NLS described herein. In some aspects, an NLS may promote nuclear localization of the fusion protein. II. POLYNUCLEOTIDES AND VECTORS AND RELATED METHODS FOR DELIVERY In some aspects, provided are polynucleotides encoding any of the DNA-targeting systems described herein or a portion or a component of any of the foregoing. In some aspects, the polynucleotides can encode any of the components of the epigenetic-modifying DNA-targeting system, and/or any nucleic acid or proteinaceous molecule necessary to carry out aspects of the methods of the disclosure. In particular embodiments, provided are polynucleotides encoding any of the fusion proteins described herein, and/or any of the gRNAs described herein.

In some embodiments, provided are polynucleotides comprising the gRNAs described herein. In some embodiments, the gRNA is transcribed from a genetic construct (i.e. vector or plasmid) in the target cell. In some embodiments, the gRNA is produced by in vitro transcription and delivered to the target cell. In some embodiments, the gRNA comprises one or more modified nucleotides for increased stability. In some embodiments, the gRNA is delivered to the target cell pre-complexed as a RNP with the fusion protein.

In some embodiments, the polynucleotide is RNA or DNA. In some embodiments, the polynucleotide, such as a polynucleotide encoding a provided fusion protein, is mRNA. In some embodiments, the gRNA is provided as RNA and a polynucleotide encoding the fusion protein is mRNA. The mRNA can be 5' capped and/or 3' polyadenylated. In another embodiment, a polynucleotide provided herein, such as a polynucleotide encoding a provided fusion protein, is DNA. The DNA can be present in a vector.

In some embodiments, the polynucleotide is an mRNA molecule that comprises a sequence encoding a DNMT3A/L-dCas9-KRAB fusion protein, such as the sequence set forth in SEQ ID NO:680, or a sequence having at least about 80%, 85%, 90%, 91%, 92%, 93%, 94%, 95%, 96%, 97%, 98%, 99%, or 100% sequence identity thereto. In some embodiments, the polynucleotide is set forth in SEQ ID NO:680.

In some embodiments, a provided polynucleotide encodes a fusion protein as described herein that includes (a) a DNA-binding domain for targeting to a target site in a Hepatitis B viral DNA sequence, such as a gene or regulatory element thereof, for example any as described herein; and (b) at least one effector domain capable of reducing transcription of the gene. In some embodiments, the at least one effector domain is a transcriptional repressor effector domain. In some embodiments, the fusion protein includes a fusion protein of a Cas protein or variant thereof and at least one transcriptional repressor effector domain capable of reducing transcription of a gene. In some embodiments, the Cas is a dCas, such as dCas9. In some embodiments, the dCas9 is a dSpCas9, such as polynucleotide encoding a dSpCas9 set forth in SEQ ID NO: 599. Examples of such domains and fusion proteins include any as described in Section I.

In some embodiments, all of the components of the DNA-targeting systems provided herein are encoded in one polynucleotide. In some embodiments, the polynucleotide encodes a fusion protein comprising a Cas DNA-targeting domain and an effector domain, and also encodes a gRNA that targets to a target site of a HepB viral sequence, such as a gene or a regulatory element thereof.

In some embodiments, all of the components of a multiplex DNA-targeting system provided herein are encoded in one polynucleotide. In some aspects, a multiplex DNA-targeting system includes at least a first DNA-targeting module and a second DNA-targeting module, in which the first DNA-targeting module and the second DNA-targeting module are encoded in one polynucleotide, such as a first polynucleotide. In some embodiments, the first DNA-targeting module and the second DNA-targeting module are encoded in one polynucleotide, such as a first polynucleotide. In some embodiments, all of the components of a multiplexed DNA-targeting systems provided herein are encoded in multiple individual polynucleotides, such as a first polynucleotide and a second polynucleotide.

In some embodiments, the modules of a multiplex DNA-targeting system include a Cas DNA-binding domain, in which the first DNA-targeting module contains a first Cas protein and the second DNA-targeting module contains a second Cas protein, whereby the first Cas protein and the second Cas protein are encoded in a first polynucleotide. In some such embodiments, the first gRNA of the first DNA-targeting module and the second gRNA of the second DNA-targeting module are encoded in the first polynucleotide. In some such embodiments, the first gRNA of the first DNA-targeting module and the second gRNA of the second DNA-targeting module are encoded in a second polynucleotide.

In some embodiments, the modules of a multiplex DNA-targeting system include a Cas DNA-binding domain, in which the first DNA-targeting module contains a first Cas protein and the second DNA-targeting module contains a second Cas protein, whereby the first Cas protein and the second Cas protein are encoded by separate polynucleotides, such as in a first polynucleotide and a second polynucleotide. In some such embodiments, the first gRNA of the first DNA-targeting module is encoded in the first polynucleotide and the second gRNA of the second DNA-targeting module is encoded in the second polynucleotide. In some embodiments, the first Cas protein and the first gRNA are encoded in a first polynucleotide, and the second Cas protein and the second gRNA are encoded in a second polynucleotide.

In some embodiments, the modules of a multiplex DNA-targeting system each include a Cas DNA-binding domain, in which the Cas protein of the first DNA-targeting module and the second DNA-targeting module is the same and encoded by the same nucleotide sequence. In some embodiments, the Cas protein, the first gRNA, and the second gRNA are encoded in a first polynucleotide.

In some embodiments, the multiplex DNA-targeting system may contain a third DNA-binding module. In some embodiments, the components of the third DNA-binding module are encoded by the first polynucleotide, the second polynucloeitde, or are encoded by a third polynucleotide.

In some embodiments, the polynucleotide encoding a DNA-binding domain of a DNA-targeting system or of a module of a multiplex DNA-targeting system comprises a sequence encoding a dCas9-KRAB fusion protein. In some embodiments, the polynucleotide encoding dSpCas9-KRAB fusion protein comprises the sequence set forth in SEQ ID NO:594, or a sequence having at least about 80%, 85%, 90%, 91%, 92%, 93%, 94%, 95%, 96%, 97%, 98%, 99%, or 100% sequence identity thereto. In some embodiments, the polynucleotide encoding dCas9-KRAB fusion protein is set forth in SEQ ID NO: 594. In some embodiments, the polynucleotide encodes a dSpCas9-KRAB fusion protein that has an amino acid sequence comprising SEQ ID NO: 595, or a sequence having at least about 80%, 85%, 90%, 91%, 92%, 93%, 94%, 95%, 96%, 97%, 98%, 99%, or 100% sequence identity thereto. In some embodiments, the polynucleotide encodes a dCas9-KRAB fusion protein that has the amino acid sequence set forth in SEQ ID NO: 595. In some embodiments, the polynucleotide is RNA or DNA. In some embodiments, the polynucleotide, such as a polynucleotide encoding a provided fusion protein, is mRNA. The mRNA can be 5' capped and/or 3' polyadenylated. In another embodiment, a polynucleotide provided herein, such as a polynucleotide encoding a provided fusion protein, is DNA. The DNA can be present in a vector.

In some embodiments, the polynucleotide encoding a DNA-binding domain of a DNA-targeting system or of a module of a multiplex DNA-targeting system comprises a sequence encoding a DNMT3A/L-dCas9-KRAB fusion protein. In some embodiments, the polynucleotide encoding DNMT3A/L-dCas9-KRAB fusion protein comprises the sequence set forth in SEQ ID NO:644, or a sequence having at least about 80%, 85%, 90%, 91%, 92%, 93%, 94%, 95%, 96%, 97%, 98%, 99%, or 100% sequence identity thereto. In some embodiments, the polynucleotide encoding DNMT3A/L-dCas9-KRAB fusion protein is set forth in SEQ ID NO: 644. In some embodiments, the polynucleotide encodes a DNMT3A/L-dCas9-KRAB fusion protein that has an amino acid sequence comprising SEQ ID NO: 645, or a sequence having at least about 80%, 85%, 90%, 91%, 92%, 93%, 94%, 95%, 96%, 97%, 98%, 99%, or 100% sequence identity thereto. In some embodiments, the polynucleotide encodes a DNMT3A/L-dCas9-KRAB fusion protein that has the amino acid sequence set forth in SEQ ID NO: 645. In some embodiments, the polynucleotide is RNA or DNA. In some embodiments, the polynucleotide, such as a polynucleotide encoding a provided fusion protein, is mRNA. The mRNA can be 5' capped and/or 3' polyadenylated. In another embodiment, a polynucleotide provided herein, such as a polynucleotide encoding a provided fusion protein, is DNA. The DNA can be present in a vector.

In some embodiments, the polynucleotide comprises a sequence encoding a DNMT3A/L-dCas9-KRAB fusion protein. In some embodiments, the polynucleotide encoding a DNMT3A/L-dCas9-KRAB fusion protein comprises the sequence set forth in SEQ ID NO:646, or a sequence having at least about 80%, 85%, 90%, 91%, 92%, 93%, 94%, 95%, 96%, 97%, 98%, 99%, or 100% sequence identity thereto. In some embodiments, the polynucleotide encoding a DNMT3A/L-dCas9-KRAB fusion protein is set forth in SEQ ID NO: 646. In some embodiments, the polynucleotide encodes a DNMT3A/L-dCas9-KRAB fusion protein that has an amino acid sequence comprising SEQ ID NO: 647, or a sequence having at least about 80%, 85%, 90%, 91%, 92%, 93%, 94%, 95%, 96%, 97%, 98%, 99%, or 100% sequence identity thereto. In some embodiments, the polynucleotide encodes a DNMT3A/L-dCas9-KRAB fusion protein that has the amino acid sequence set forth in SEQ ID NO: 647. In some embodiments, the polynucleotide is RNA or DNA. In some embodiments, the polynucleotide, such as a polynucleotide encoding a provided fusion protein, is mRNA. The mRNA can be 5' capped and/or 3' polyadenylated. In another embodiment, a polynucleotide provided herein, such as a polynucleotide encoding a provided fusion protein, is DNA. The DNA can be present in a vector.

In some embodiments, the polynucleotide comprises a sequence encoding a DNMT3A/L-dCas9-KRAB fusion protein. In some embodiments, the polynucleotide encoding a DNMT3A/L-dCas9-KRAB fusion protein comprises the sequence set forth in SEQ ID NO:648, or a sequence having at least about 80%, 85%, 90%, 91%, 92%, 93%, 94%, 95%, 96%, 97%, 98%, 99%, or 100% sequence identity thereto. In some embodiments, the polynucleotide encoding a DNMT3A/L-dCas9-KRAB fusion protein is set forth in SEQ ID NO: 648. In some embodiments, the polynucleotide encodes a DNMT3A/L-dCas9-KRAB-DNMT3A/L fusion protein that has an amino acid sequence comprising SEQ ID NO: 649, or a sequence having at least about 80%, 85%, 90%, 91%, 92%, 93%, 94%, 95%, 96%, 97%, 98%, 99%, or 100% sequence identity thereto. In some embodiments, the polynucleotide encodes a DNMT3A/L-dCas9-KRAB fusion protein that has the amino acid sequence set forth in SEQ ID NO: 649. In some embodiments, the polynucleotide is RNA or DNA. In some embodiments, the polynucleotide, such as a polynucleotide encoding a provided fusion protein, is mRNA. The mRNA can be 5' capped and/or 3' polyadenylated. In another embodiment, a polynucleotide provided herein, such as a polynucleotide encoding a provided fusion protein, is DNA. The DNA can be present in a vector.

Also provided herein is a vector that contains any of the provided polynucleotides. In some embodiments, the vector comprises a genetic construct, such as a plasmid or an expression vector.

In some embodiments, the expression vector comprising the sequence encoding the fusion protein of a DNA-targeting system provided herein can further comprise a polynucleotide sequence encoding at least one gRNA. The sequence encoding the gRNA can be operably linked to at least one transcriptional control sequence for expression of the gRNA in the cell. For example, DNA encoding the gRNA can be operably linked to a promoter sequence that is recognized by RNA polymerase III (Pol III). Examples of suitable Pol III promoters include, but are not limited to, mammalian U6, U3, H1, and 7SL RNA promoters.

An expression vector (such as a DNA or RNA (e.g. mRNA) expression vector) can comprise any number of suitable transcriptional control sequences. For example, transcriptional control sequences may include enhancers, promoters, or untranslated regions (UTRs) such as 3'UTRs or 5'UTRs. In some embodiments, the UTRs are encoded by and/or present in the expression vector (e.g. a DNA vector). In some embodiments, mRNA encoding the fusion protein includes UTRs. In some aspects, different transcriptional control sequences may be selected for use in an expression vector, for example to achieve the appropriate level of expression. For example, in some embodiments, UTRs can be selected that facilitate expression in a specific tissue or cell type (e.g. liver or hepatocyte). In some embodiments, a 5'UTR of the expression vector encodes or comprises the sequence set forth in SEQ ID NO:681. In some embodiments, a 3'UTR of the expression vector encodes or comprises the sequence set forth in SEQ ID NO:682.

In some embodiments, provided is a vector containing a polynucleotide that encodes a fusion protein comprising a DNA-binding domain comprising a dCas and at least one effector domain capable of decreasing transcription of a gene and/or regulatory element thereof, and a polynucleotide or combination of polynucleotides encoding a gRNA, or combination of gRNAs, such as two gRNAs, or three gRNAs. In some embodiments, the dCas is a dCas9, such as dSpCas9. In some embodiments, the polynucleotide encodes a fusion protein that includes a dSpCas9 set forth in SEQ ID NO: 599. In some embodiments, the polynucleotide(s) encodes a gRNA or combination of gRNAs as described in Section I.B.ii. For example, the polynucleotide can encode a combination of gRNAs, each comprising a spacer sequence selected from any one of SEQ ID NOS:196-229, 230-295, or 296-390 or a contiguous portion thereof of at least 14 nt. In some embodiments the polynucleotide(s) encodes a combination of gRNAs that each comprise a sequence set forth in any one of SEQ ID NOS: 391-424, 425-490, or 491-585.

In some embodiments, the effector domain is KRAB. In some embodiments, the effector domain is DNMT3A/L. In some embodiments, the vector includes a polynucleotide that encodes the amino acid sequence comprising SEQ ID NO: 590, SEQ ID NO: 595, SEQ ID NO:645, SEQ ID NO:647, or SEQ ID NO:649, or a sequence having at least about 80%, 85%, 90%, 91%, 92%, 93%, 94%, 95%, 96%, 97%, 98%, 99%, or 100% sequence identity thereto, and a polynucleotide or polynucleotides that encode a gRNA or combination of gRNAs such as any described in Section I.B.ii. In some embodiments, the polynucleotide(s) encodes a combination of gRNAs, each comprising a spacer sequence selected from any one of SEQ ID NOS: 196-229, 230-295, or 296-390, or a contiguous portion thereof of at least 14 nt. In some embodiments, each gRNA further comprises the sequence set forth in SEQ ID NO: 587. In some embodiments the polynucleotide(s) encodes a combination of gRNAs that each comprises a sequence set forth in any one of SEQ ID NOS: 391-424, 425-490, or 491-585.

In some embodiments, the polynucleotide encodes the fusion protein and the at least one gRNA.

In some embodiments, the polynucleotide as provided herein can be codon optimized for efficient translation into protein in the eukaryotic cell or animal of interest. For example, codons can be optimized for expression in humans, mice, rats, hamsters, cows, pigs, cats, dogs, fish, amphibians, plants, yeast, insects, and so forth. Programs for codon optimization are available as freeware. Commercial codon optimization programs are also available.

In some embodiments, a polynucleotide described herein can comprise one or more transcription and/or translation control elements. Depending on the host/vector system utilized, any of a number of suitable transcription and translation control elements, including constitutive and inducible promoters, transcription enhancer elements, transcription terminators, etc. can be used in the expression vector.

Non-limiting examples of suitable eukaryotic promoters (i.e., promoters functional in a eukaryotic cell) include those from cytomegalovirus (CMV) immediate early, herpes simplex virus (HSV) thymidine kinase, early and late SV40, long terminal repeats (LTRs) from retrovirus, human elongation factor-1 promoter (EF1), a hybrid construct comprising the cytomegalovirus (CMV) enhancer fused to the chicken beta-actin promoter (CAG), murine stem cell virus promoter (MSCV), phosphoglycerate kinase-1 locus promoter (PGK), and mouse metallothionein-I.

For expressing small RNAs, including guide RNAs used in connection with the DNA-targeting systems, various promoters such as RNA polymerase III promoters, including for example U6 and H1, can be advantageous. Descriptions of and parameters for enhancing the use of such promoters are known in the art, and additional information and approaches are regularly being described; see, e.g., Ma, H. et al., Molecular Therapy-Nucleic Acids 3, e161 (2014) doi:10.1038/mtna.2014.12.

The expression vector can also contain a ribosome binding site for translation initiation and a transcription terminator. The expression vector can also comprise appropriate sequences for amplifying expression. The expression vector can also include nucleotide sequences encoding non-native tags (e.g., histidine tag, hemagglutinin tag, green fluorescent protein, etc.) that are fused to the site-directed polypeptide, thus resulting in a fusion protein.

A promoter can be an inducible promoter (e.g., a heat shock promoter, tetracycline-regulated promoter, steroid-regulated promoter, metal-regulated promoter, estrogen receptor-regulated promoter, etc.). The promoter can be a constitutive promoter (e.g., CMV promoter, UBC promoter). In some cases, the promoter can be a spatially restricted and/or temporally restricted promoter (e.g., a tissue specific promoter, a cell type specific promoter (e.g. a T cell specific promoter), etc.).

Expression vectors contemplated include, but are not limited to, viral vectors based on vaccinia virus, poliovirus, adenovirus, adeno-associated virus, SV40, herpes simplex virus, human immunodeficiency virus, retrovirus (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus) and other recombinant vectors. Other vectors contemplated for eukaryotic target cells include, but are not limited to, the vectors pXT1, pSG5, pSVK3, pBPV, pMSG, and pSVLSV40 (Pharmacia). Other vectors can be used so long as they are compatible with the host cell.

In some embodiments, the vector is a viral vector, such as an adeno-associated virus (AAV) vector, a retroviral vector, a lentiviral vector, or a gammaretroviral vector. In some embodiments. In some embodiments, the viral vector is an adeno-associated virus (AAV) vector. In some embodiments, the AAV vector is selected from among an AAV1, AAV2, AAV3, AAV4, AAV5, AAV6, AAV7, AAV8, or AAV9 vector. In some embodiments, the vector is a lentiviral vector. In some embodiments, the vector is a non-viral vector, for example a lipid nanoparticle, a liposome, an exosome, or a cell penetrating peptide. In some embodiments, the vector comprises one vector, or two or more vectors.

In some embodiments, a vector described herein is or comprises a lipid nanoparticle (LNP). In some embodiments, any of the epigenetic-modifying DNA-targeting systems, gRNAs, Cas-gRNA combinations, polynucleotides, fusion proteins, or components thereof described herein, are incorporated in lipid nanoparticles (LNPs), such as for delivery. In some embodiments, the lipid nanoparticle is a vector for delivery. In some embodiments, the nanoparticle may comprise at least one lipid. The lipid may be selected from, but is not limited to, DLin-DMA, DLin-K-DMA, 98N12-5, C12-200, DLin-MC3-DMA, DLin-KC2-DMA, DODMA, PLGA, PEG, PEG-DMG and PEGylated lipids. In another aspect, the lipid may be a cationic lipid such as, but not limited to, DLin-DMA, DLin-D-DMA, DLin-MC 3-DMA, DLin-KC2-DMA and DODMA.

Lipid nanoparticles can be used for the delivery of encapsulated or associated (e.g., complexed) therapeutic agents, including nucleic acids and proteins, such as those encoding and/or comprising CRISPR/Cas systems. See, e.g., U.S. Pat. Nos. 10,723,692, 10,941,395, and WO 2015/035136.

In some embodiments, the provided methods involve use of a lipid nanoparticle (LNP) comprising mRNA, such as mRNA encoding a protein component of any of the provided DNA-targeting systems, for example any of the fusion proteins provided herein. In some embodiments, the mRNA can be produced using methods known in the art such as in vitro transcription. In some embodiments of the method, the mRNA comprises a 5' cap. In some embodiments, the 5' cap is an altered nucleotide on the 5' end of primary transcripts such as messenger RNA. In some aspects, the 5' caps of the mRNA improves one or more of RNA stability and processing, mRNA metabolism, the processing and maturation of an RNA transcript in the nucleus, transport of mRNA from the nucleus to the cytoplasm, mRNA stability, and efficient translation of mRNA to protein. In some embodiments, a 5' cap can be a naturally-occurring 5' cap or one that differs from a naturally-occurring cap of an mRNA. A 5' cap may be any 5' cap known to a skilled artisan. In certain embodiments, the 5' cap is selected from the group consisting of an Anti-Reverse Cap Analog (ARCA) cap, a 7-methyl-guanosine (7mG) cap, a CleanCap® analog, a vaccinia cap, and analogs thereof. For instance, the 5' cap may include, without limitation, an anti-reverse cap analogs (ARCA) (U.S. Pat. No. 7,074,596), 7-methyl-guanosine, CleanCap® analogs, such as Cap 1 analogs (Trilink; San Diego, CA), or enzymatically capped using, for example, a vaccinia capping enzyme or the like. In some embodiments, the mRNA may be polyadenylated. The mRNA may contain various 5' and 3' untranslated sequence elements to enhance expression of the encoded protein and/or stability of the mRNA itself. Such elements can include, for example, posttranslational regulatory elements such as a woodchuck hepatitis virus post-transcriptional regulatory element (WPRE). In some embodiments, the mRNA comprises at least one nucleoside modification. The mRNA may contain modifications of naturally-occurring nucleosides to nucleoside analogs. Any nucleoside analogs known in the art are envisioned. Such nucleoside analogs can include, for example, those described in U.S. Pat. No. 8,278,036. In certain embodiments of the method, the nucleoside modification is selected from the group consisting of a modification from uridine to pseudouridine and uridine to N1-methyl pseudouridine. In particular embodiments of the method the nucleoside modification is from uridine to pseudouridine.

In some embodiments, the described LNP composition comprises a PEG-lipid (e.g., a lipid comprising a polyethylene glycol component). In some embodiments, the described LNP composition comprises two or more PEG-lipids. Exemplary PEG-lipids also include, but are not limited to, PEG-modified phosphatidylethanolamines, PEG-modified phosphatidic acids, PEG-modified ceramides, PEG-modified dialkylamines, PEG-modified diacylglycerols, PEG-modified dialkylglycerols, and mixtures thereof. For example, the one or more PEG-lipids can comprise PEG-c-DOMG, PEG-DMG, PEG-DLPE, PEG-DMPE, PEG-DPPC, a PEG-DSPE lipid, or a combination thereof. In some embodiments, PEG moiety is an optionally substituted linear or branched polymer of ethylene glycol or ethylene oxide. In some embodiments, the PEG moiety is substituted, e.g., by one or more alkyl, alkoxy, acyl, hydroxy, or aryl groups. In some embodiments, the PEG moiety includes PEG copolymer such as PEG-polyurethane or PEG-polypropylene (see, e.g., j. Milton Harris, Poly(ethylene glycol) chemistry: biotechnical and biomedical applications (1992)). In some embodiments, a PEG-lipid is a PEG-lipid conjugate. In some embodiments, the PEG-lipid comprises from about 0.1 mol % to about 6 mol % of a total lipid content present in said nanoparticle composition. In some embodiments, a number average molecular weight of the PEG-lipid is from about 200 Da to about 5000 Da. In some embodiments, the LNP is conjugated to N-Acetylgalactosamine (GalNAc), an amino sugar derivative of galactose. GalNAc is a sugar molecule that can recognize and bind to a cell surface protein, the asialoglycoprotein receptor (ASGPR). ASGPR is abundantly expressed on liver cells (hepatocytes). In some embodiments, GalNAc conjugation to LNPs (e.g., 0.15% molecular weight of GalNAc-PEG lipid) improves delivery of the LNP to the hepatocytes in mouse models (e.g., FRG mouse models). In some embodiments, GalNAc conjugation to LNPs can improve delivery to hepatocytes. In some embodiments, the lipid nanoparticle comprises GalNAC-conjugated lipids (e.g. a GalNAc-PEG lipid). In some embodiments, the molar percentage of lipids that are GalNAC-conjugated in a lipid nanoparticle is between about 0% and about 2%. In some embodiments, the molar percentage of lipids that are GalNAC-conjugated in a lipid nanoparticle is at or about 0.1%, at or about 0.2%, at or about 0.3%, at or about 0.4%, at or about 0.5%, at or about 0.6%, at or about 0.7%, at or about 0.8%, at or about 0.9%, at or about 1.0%, at or about 1.1%, at or about 1.2%, at or about 1.3%, at or about 1.4%, at or about 1.5%, at or about 1.6%, at or about 1.7%, at or about 1.8%, at or about 1.9%, at or about 2.0%, or more, or a value in between any of the foregoing.

In some embodiments, LNPs useful for in the present methods comprise a cationic lipid selected from DLin-DMA (1,2-dilinoleyloxy-3-dimethylaminopropane), DLin-MC3-DM A (dilinoleylmethyl-4-dimethylaminobutyrate), DLin-KC2-DMA (2,2-dilinoleyl-4-(2-dimethylaminoethyl)-[1,3]-dioxolane), DODMA (1,2-dioleyloxy-N,N-dimethyl-3-aminopropane), SS-OP (Bis[2-(4-{2-[4-(cis-9 octadecenoyloxy)phenylacetoxy]ethylJpiperidinyl)ethyl] disulfide), and derivatives thereof. DLin-MC3-DMA and derivatives thereof are described, for example, in WO 2010/144740. DODMA and derivatives thereof are described, for example, in U.S. Pat. No. 7,745,651 and Mok et al. (1999), Biochimica et Biophysica Acta, 1419(2): 137-150. DLin-DMA and derivatives thereof are described, for example, in U.S. Pat. No. 7,799,565. DLin-KC2-DMA and derivatives thereof are described, for example, in U.S. Pat. No. 9,139,554. SS-OP (NOF America Corporation, White Plains, NY) is described, for example, at www.nofamerica.com/store/index.php?dispatch=products.view&product_id=962. Additional and non-limiting examples of cationic lipids include methylpyridiyl-dialkyl acid (MPDACA), palmitoyl-oleoyl-nor-arginine (PONA), guanidino-dialkyl acid (GUA-DACA), 1,2-di-0-octadecenyl-3-trimethylammonium propane (DOTMA), 1,2-dioleoyl-3-trimethylammoniumpropane (DOTAP), Bis{2-[N-methyl-N-(a-D-tocopherolhemisuccinatepropyl) amino]ethyl}disulfide (SS-33/3AP05), Bis{2-[4-(a-D-tocopherolhemisuccinateethyl) piperidyl]ethyl}disulfide (SS33/4PE15), Bis{2-[4-(cis-9-octadecenoateethyl)-1-piperidinyl]ethyl}disulfide (SS18/4PE16), and Bis{2-[4-(cis,cis-9,12-octadecadienoateethyl)-1-piperidinyl]ethyl}disulfide (SS18/4PE13). In further embodiments, the lipid nanoparticles also comprise one or more non-cationic lipids and a lipid conjugate.

In some embodiments, the molar concentration of the cationic lipid is from about 20% to about 80%, from about 30% to about 70%, from about 40% to about 60%, from about 45% to about 55%, or about 20%, about 25%, about 30%, about 35%, about 40%, about 45%, about 50%, about 55%, about 60%, about 65%, about 70%, about 75%, or about 80% of the total lipid molar concentration, wherein the total lipid molar concentration is the sum of the cationic lipid, the non-cationic lipid, and the lipid conjugate molar concentrations. In certain embodiments, the lipid nanoparticles comprise a molar ratio of cationic lipid to any of the polynucleotides of from about 1 to about 20, from about 2 to about 16, from about 4 to about 12, from about 6 to about 10, or about 1, about 2, about 3, about 4, about 5, about 6, about 7, about 8, about 9, about 10, about 11, about 12, about 13, about 14, about 15, about 16, about 17, about 18, about 19, or about 20.

In some embodiments, the lipid nanoparticles can comprise at least one non-cationic lipid. In particular embodiments, the molar concentration of the non-cationic lipids is from about 20% to about 80%, from about 30% to about 70%, from about 40% to about 70%, from about 40% to about 60%, from about 46% to about 50%, or about 20%, about 25%, about 30%, about 35%, about 40%, about 45%, about 48.5%, about 50%, about 55%, about 60%, about 65%, about 70%, about 75%, or about 80% of the total lipid molar concentration. Non-cationic lipids include, in some embodiments, phospholipids and steroids.

In some embodiments, phospholipids useful for the lipid nanoparticles described herein include, but are not limited to, 1,2-Distearoyl-sn-glycero-3-phosphocholine (DSPC), 1,2-Didecanoyl-sn-glycero-3-phosphocholine (DDPC), 1,2-Dierucoyl-sn-glycero-3-phosphate(Sodium Salt) (DEPA-NA), 1,2-Dierucoyl-sn-glycero-3-phosphocholine (DEPC), 1,2-Dierucoyl-sn-glycero-3-phosphoethanolamine (DEPE), 1,2-Dierucoyl-sn-glycero-3[Phospho-rac-(1-glycerol)(Sodium Salt) (DEPG-NA), 1,2-Dilinoleoyl-sn-glycero-3-phosphocholine (DLOPC), 1,2-Dilauroyl-sn-glycero-3-phosphate(Sodium Salt) (DLPA-NA), 1,2-Dilauroyl-sn-glycero-3-phosphocholine (DLPC), 1,2-Dilauroyl-sn-glycero-3-phosphoethanolamine (DLPE), 1,2-Dilauroyl-sn-glycero-3 [Phospho-rac-(1-glycerol . . . )(Sodium Salt) (DLPG-NA), 1,2-Dilauroyl-sn-glycero-3[Phospho-rac-(1-glycerol)(Ammonium Salt) (DLPG-NH4), 1,2-Dilauroyl-sn-glycero-3-phosphoserine(Sodium Salt) (DLPS-NA), 1,2-Dimyristoyl-sn-glycero-3-phosphate(SodiumSalt) (DMPA-NA), 1,2-

Dimyristoyl-sn-glycero-3-phosphocholine (DMPC), 1,2-Dimyristoyl-sn-glycero-3-phosphoethanolamine (DMPE), 1,2-Dimyristoyl-sn-glycero-3[Phospho-rac-(1-glycerol)(Sodium Salt) (DMPG-NA), 1,2-Dimyristoyl-sn-glycero-3 [Phospho-rac-(1-glycerol)(Ammonium Salt) (DMPG-NH4), 1,2-Dimyristoyl-sn-glycero-3[Phospho-rac-(1-glycerol)(Sodium/Ammonium Salt) (DMPG-NH4/NA), 1,2-Dimyristoyl-sn-glycero-3-phosphoserine(Sodium Salt) (DMPS-NA), 1,2-Dioleoyl-sn-glycero-3-phosphate(Sodium Salt) (DOPA-NA), 1,2-Dioleoyl-sn-glycero-3-phosphocholine (DOPC), 1,2-Dioleoyl-sn-glycero-3-phosphoethanolamine (DOPE), 1,2-Dioleoyl-sn-glycero-3[Phospho-rac-(1-glycerol)(Sodium Salt) (DOPG-NA), 1,2-Dioleoyl-sn-glycero-3-phosphoserine(Sodium Salt) (DOPS-NA), 1,2-Dipalmitoyl-sn-glycero-3-phosphate(Sodium Salt) (DPPA-NA), 1,2-Dipalmitoyl-sn-glycero-3-phosphocholine (DPPC), 1,2-Dipalmitoyl-sn-glycero-3-phosphoethanolamine (DPPE), 1,2-Dipalmitoyl-sn-glycero-3[Phospho-rac-(1-glycerol)(Sodium Salt) (DPPG-NA), 1,2-Dipalmitoyl-sn-glycero-3 [Phospho-rac-(1-glycerol)(Ammonium Salt) (DPPG-NH4), 1,2-Dipalmitoyl-sn-glycero-3-phosphoserine(Sodium Salt) (DPPS-NA), 1,2-Distearoyl-sn-glycero-3-phosphate(Sodium Salt) (DSPA-NA), 1,2-Distearoyl-sn-glycero-3-phosphoethanolamine (DSPE), 1,2-Distearoyl-sn-glycero-3 [Phospho-rac-(1-glycerol)(Sodium Salt) (DSPG-NA), 1,2-Distearoyl-sn-glycero-3[Phospho-rac-(1-glycerol) (Ammonium Salt) (DSPG-NH4), 1,2-Distearoyl-sn-glycero-3-phosphoserine(Sodium Salt) (DSPS-NA), Egg-PC (EPC), Hydrogenated Egg PC (HEPC), Hydrogenated Soy PC (HSPC), 1-Myristoyl-sn-glycero-3-phosphocholine (LY S OPCM YRIS TIC), 1-Palmitoyl-sn-glycero-3-phosphocholine (LYSOPCPALMITIC), 1-Stearoyl-sn-glycero-3-phosphocholine (LYSOPC STEARIC), 1-Myristoyl-2-palmitoyl-sn-glycero3-phosphocholine (MPPC), 1-Myristoyl-2-stearoyl-sn-glycero-3-phosphocholine (MSPC), 1-Palmitoyl-2-myristoyl-sn-glycero-3-phosphocholine (PMPC), 1-Palmitoyl-2-oleoyl-sn-glycero-3-phosphocholine (POPC), 1-Palmitoyl-2-oleoyl-sn-glycero-3-phosphoethanolamine (POPE), 1-Palmitoyl-2-oleoyl-sn-glycero-3[Phospho-rac-(1-glycerol)](Sodium Salt) (POPG-NA), 1-Palmitoyl-2-stearoyl-sn-glycero-3-phosphocholine (PS PC), 1-Stearoyl-2-myristoyl-sn-glycero-3-phosphocholine (SMPC), 1-Stearoyl-2-oleoyl-sn-glycero-3-phosphocholine (SOPC), and 1-Stearoyl-2-palmitoyl-sn-glycero-3-phosphocholine (SPPC). In particular embodiments, the phospholipid is DSPC. In particular embodiments, the phospholipid is DOPE. In particular embodiments, the phospholipid is DOPC.

In some embodiments, the non-cationic lipids comprised by the lipid nanoparticles include one or more steroids. Steroids useful for the lipid nanoparticles described herein include, but are not limited to, cholestanes such as cholesterol, cholanes such as cholic acid, pregnanes such as progesterone, androstanes such as testosterone, and estranes such as estradiol. Further steroids include, but are not limited to, cholesterol (ovine), cholesterol sulfate, desmosterol-d6, cholesterol-d7, lathosterol-d7, desmosterol, stigmasterol, lanosterol, dehydrocholesterol, dihydrolanosterol, zymosterol, lathosterol, zymosterol-d5, 14-demethyl-lanosterol, 14-demethyl-lanosterol-d6, 8(9)-dehydrocholesterol, 8(14)-dehydrocholesterol, diosgenin, DHEA sulfate, DHEA, lanosterol-d6, dihydrolanosterol-d7, campesterol-d6, sitosterol, lanosterol-95, Dihydro FF-MAS-d6, zymostenol-d7, zymostenol, sitostanol, campestanol, campesterol, 7-dehydrodesmosterol, pregnenolone, sitosterol-d7, Dihydro T-MAS, Delta 5-avenasterol, Brassicasterol, Dihydro FF-MAS, 24-methylene cholesterol, cholic acid derivatives, cholesteryl esters, and glycosylated sterols. In particular embodiments, the lipid nanoparticles comprise cholesterol.

In some embodiments, the lipid nanoparticles comprise a lipid conjugate. Such lipid conjugates include, but are not limited to, ceramide PEG derivatives such as C8 PEG2000 ceramide, C16 PEG2000 ceramide, C8 PEG5000 ceramide, C16 PEG5000 ceramide, C8 PEG750 ceramide, and C16 PEG750 ceramide, phosphoethanolamine PEG derivatives such as 16:0 PEG5000PE, 14:0 PEG5000 PE, 18:0 PEG5000 PE, 18:1 PEG5000 PE, 16:0 PEG3000 PE, 14:0 PEG3000 PE, 18:0 PEG3000 PE, 18:1 PEG3000 PE, 16:0 PEG2000 PE, 14:0 PEG2000 PE, 18:0 PEG2000 PE, 18:1 PEG2000 PE 16:0 PEG1000 PE, 14:0 PEG1000 PE, 18:0 PEG1000 PE, 18:1 PEG 1000 PE, 16:0 PEG750 PE, 14:0 PEG750 PE, 18:0 PEG750 PE, 18:1 PEG750 PE, 16:0 PEG550 PE, 14:0 PEG550 PE, 18:0 PEG550 PE, 18:1 PEG550 PE, 16:0 PEG350 PE, 14:0 PEG350 PE, 18:0 PEG350 PE, and 18:1 PEG350, sterol PEG derivatives such as Chol-PEG600, and glycerol PEG derivatives such as DMG-PEG5000, DSG-PEG5000, DPG-PEG5000, DMG-PEG3000, DSG-PEG3000, DPG-PEG3000, DMG-PEG2000, DSG-PEG2000, DPG-PEG2000, DMG-PEG1000, DSG-PEG1000, DPG-PEG1000, DMG-PEG750, DSG-PEG750, DPG-PEG750, DMG-PEG550, DSG-PEG550, DPG-PEG550, DMG-PEG350, DSG-PEG350, and DPG-PEG350. In some embodiments, the lipid conjugate is a DMG-PEG. In some particular embodiments, the lipid conjugate is DMG-PEG2000. In some particular embodiments, the lipid conjugate is DMG-PEG5000.

It is within the level of a skilled artisan to select the cationic lipids, non-cationic lipids and/or lipid conjugates which comprise the lipid nanoparticle, as well as the relative molar ratio of such lipids to each other, such as based upon the characteristics of the selected lipid(s), the nature of the delivery to the intended target cells, and the characteristics of the nucleic acids and/or proteins to be delivered. Additional considerations include, for example, the saturation of the alkyl chain, as well as the size, charge, pH, pKa, fusogenicity and toxicity of the selected lipid(s). Thus, the molar ratios of each individual component may be adjusted accordingly.

The lipid nanoparticles for use in the method can be prepared by various techniques which are known to a skilled artisan. Nucleic acid-lipid particles and methods of preparation are disclosed in, for example, U.S. Patent Publication Nos. 20040142025 and 20070042031.

In some embodiments, the lipid nanoparticles will have a size within the range of about 25 to about 500 nm. In some embodiments, the lipid nanoparticles have a size from about 50 nm to about 300 nm, or from about 60 nm to about 120 nm. The size of the lipid nanoparticles may be determined by quasi-electric light scattering (QELS) as described in Bloomfield, Ann. Rev. Biophys. Bioeng., 10:421A150 (1981). A variety of methods are known in the art for producing a population of lipid nanoparticles of particular size ranges, for example, sonication or homogenization. One such method is described in U.S. Pat. No. 4,737,323.

In some embodiments, the lipid nanoparticles comprise a cell targeting molecule such as, for example, a targeting ligand (e.g., antibodies, scFv proteins, DART molecules, peptides, aptamers, and the like) anchored on the surface of the lipid nanoparticle that selectively binds the lipid nanoparticles to the targeted cell, such as any cell described herein, e.g. a hepatocyte.

In some embodiments, the vector exhibits the vector exhibits liver cell and/or hepatocyte tropism.

In some aspects, provided herein are pluralities of vectors that comprise any of the vectors described herein, and one or more additional vectors comprising one or more additional polynucleotides encoding an additional portion or an additional component of any of the DNA-targeting systems described herein, any of the gRNAs described herein, any of the fusion proteins described herein, or a portion or a component of any of the foregoing.

Provided are pluralities of vectors, that include: a first vector comprising any of the polynucleotides described herein; a second vector comprising any of the polynucleotides described herein; and optionally one or more additional vectors comprising any of the polynucleotides described herein.

In some aspects, vectors provided herein may be referred to as delivery vehicles. In some aspects, any of the DNA-targeting systems, components thereof, or polynucleotides disclosed herein can be packaged into or on the surface of delivery vehicles for delivery to cells. Delivery vehicles contemplated include, but are not limited to, nanospheres, liposomes, quantum dots, nanoparticles, polyethylene glycol particles, hydrogels, and micelles. As described in the art, a variety of targeting moieties can be used to enhance the preferential interaction of such vehicles with desired cell types or locations.

Methods of introducing a nucleic acid into a host cell are known in the art, and any known method can be used to introduce a nucleic acid (e.g., an expression construct) into a cell. Suitable methods include, include e.g., viral or bacteriophage infection, transfection, conjugation, protoplast fusion, lipofection, electroporation, calcium phosphate precipitation, polyethyleneimine (PEI)-mediated transfection, DEAE-dextran mediated transfection, liposome-mediated transfection, particle gun technology, calcium phosphate precipitation, direct micro injection, nanoparticle-mediated nucleic acid delivery, and the like. In some embodiments, the composition may be delivered by mRNA delivery and ribonucleoprotein (RNP) complex delivery. Direct delivery of the RNP complex, including the DNA-binding domain complexed with the sgRNA, can eliminate the need for intracellular transcription and translation and can offer a robust platform for host cells with low transcriptional and translational activity. The RNP complexes can be introduced into the host cell by any of the methods known in the art.

Nucleic acids or RNPs of the disclosure can be incorporated into a host using virus-like particles (VLP). VLPs contain normal viral vector components, such as envelope and capsids, but lack the viral genome. For instance, nucleic acids expressing the Cas and sgRNA can be fused to the viral vector components such as gag and introduced into producer cells. The resulting virus-like particles containing the sgRNA-expressing vectors can infect the host cell for efficient editing.

Introduction of the complexes, polypeptides, and nucleic acids of the disclosure can occur by protein transduction domains (PTDs). PTDs, including the human immunodeficiency virus-1 TAT, herpes simplex virus-1 VP22, Drsophila Antennapedia Antp, and the poluarginines, are peptide sequences that can cross the cell membrane, enter a host cell, and deliver the complexes, polypeptides, and nucleic acids into the cell.

Introduction of the complexes, polypeptides, and nucleic acids of the disclosure into cells can occur by viral or bacteriophage infection, transfection, conjugation, protoplast fusion, lipofection, electroporation, nucleofection, calcium phosphate precipitation, polyethyleneimine (PEI)-mediated transfection, DEAE-dextran mediated transfection, liposome-mediated transfection, particle gun technology, calcium phosphate precipitation, direct micro-injection, nanoparticle-mediated nucleic acid delivery, and the like, for example as described in WO 2017/193107 A2, WO 2016/123578 A1, WO 2014/152432 A2, WO 2014/093661 A2, WO 2014/093655 A2, or WO 2021/226555 A2.

Various methods for the introduction of polynucleotides are well known and may be used with the provided methods and compositions. Exemplary methods include those for transfer of polynucleotides encoding the DNA targeting systems provided herein, including via viral, e.g., retroviral or lentiviral, transduction, transposons, and electroporation.

In some embodiments, polynucleotides can be cloned into a suitable vector, such as an expression vector or vectors. The expression vector can be any suitable recombinant expression vector, and can be used to transform or transfect any suitable cell. Suitable vectors include those designed for propagation and expansion or for expression or both, such as plasmids and viruses.

In some embodiments, the vector can a vector of the pUC series (Fermentas Life Sciences), the pBluescript series (Stratagene, LaJolla, Calif.), the pET series (Novagen, Madison, Wis.), the pGEX series (Pharmacia Biotech, Uppsala, Sweden), or the pEX series (Clontech, Palo Alto, Calif.). In some embodiments, animal expression vectors include pEUK-Cl, pMAM and pMAMneo (Clontech). In some embodiments, a viral vector is used, such as a lentiviral or retroviral vector. In some embodiments, the recombinant expression vectors can be prepared using standard recombinant DNA techniques. In some embodiments, vectors can contain regulatory sequences, such as transcription and translation initiation and termination codons, which are specific to the type of host into which the vector is to be introduced, as appropriate and taking into consideration whether the vector is DNA- or RNA-based. In some embodiments, the vector can contain a nonnative promoter operably linked to the nucleotide sequence encoding the recombinant receptor. In some embodiments, the promoter can be a non-viral promoter or a viral promoter, such as a cytomegalovirus (CMV) promoter, an SV40 promoter, an RSV promoter, and a promoter found in the long-terminal repeat of the murine stem cell virus. Other promoters known to a skilled artisan also are contemplated.

In some embodiments, recombinant nucleic acids are transferred into cells using recombinant infectious virus particles, such as, e.g., vectors derived from simian virus 40 (SV40), adenoviruses, or adeno-associated virus (AAV). In some embodiments, recombinant nucleic acids are transferred into cells (e.g. T cells) using recombinant lentiviral vectors or retroviral vectors, such as gamma-retroviral vectors (see, e.g., Koste et al. (2014) Gene Therapy 2014 Apr. 3. doi: 10.1038/gt.2014.25; Carlens et al. (2000) Exp Hematol 28(10): 1137-46; Alonso-Camino et al. (2013) Mol Ther Nucl Acids 2, e93; Park et al., Trends Biotechnol. 2011 Nov. 29(11): 550-557.

In some embodiments, the retroviral vector has a long terminal repeat sequence (LTR), e.g., a retroviral vector derived from the Moloney murine leukemia virus (MoMLV), myeloproliferative sarcoma virus (MPSV), murine embryonic stem cell virus (MESV), murine stem cell virus (MSCV), spleen focus forming virus (SFFV), or adeno-associated virus (AAV). Most retroviral vectors are derived from murine retroviruses. In some embodiments, the retroviruses include those derived from any avian or mammalian cell source. The retroviruses typically are amphotropic, meaning that they are capable of infecting host cells of several species, including humans. In one embodiment, the gene to be expressed replaces the retroviral gag, pol and/or env sequences. A number of illustrative retroviral systems have been described (e.g., U.S. Pat. Nos. 5,219,740; 6,207,453; 5,219,740; Miller and Rosman (1989) BioTechniques 7:980-990; Miller, A. D. (1990) Human Gene Therapy 1:5-14; Scarpa et al. (1991) Virology 180:849-852; Burns et al. (1993) Proc. Natl. Acad. Sci. USA 90:8033-8037; and Boris-Lawrie and Temin (1993) Cur. Opin. Genet. Develop. 3: 102-109.

In some embodiments, the vector is a lentiviral vector. In some embodiments, the lentiviral vector is an integrase-deficient lentiviral vector. In some embodiments, the lentiviral vector is a recombinant lentiviral vector. In some embodiments, the lentivirus is selected or engineered for a desired tropism (e.g. for heptocyte cell tropism). Methods of lentiviral production, transduction, and engineering are known, for example as described in Kasaraneni, N. et al. Sci. Rep. 8(1):10990 (2018), Ghaleh, H. E. G. et al. Biomed. Pharmacother. 128:110276 (2020), and Milone, M. C. et al. Leukemia. 32(7):1529-1541 (2018). Additional methods for lentiviral transduction are described, for example in Wang et al. (2012) J. Immunother. 35(9): 689-701; Cooper et al. (2003) Blood. 101: 1637-1644; Verhoeyen et al. (2009) Methods Mol Biol. 506: 97-114; and Cavalieri et al. (2003) Blood. 102(2): 497-505.

In some embodiments, recombinant nucleic acids are transferred into cells (e.g. T cells) via electroporation (see, e.g., Chicaybam et al, (2013) PLoS ONE 8(3): e60298 and Van Tedeloo et al. (2000) Gene Therapy 7(16): 1431-1437). In some embodiments, recombinant nucleic acids are transferred into cells via transposition (see, e.g., Manuri et al. (2010) Hum Gene Ther 21(4): 427-437; Sharma et al. (2013) Molec Ther Nucl Acids 2, e74; and Huang et al. (2009) Methods Mol Biol 506: 115-126)). Other methods of introducing and expressing genetic material into cells include calcium phosphate transfection (e.g., as described in Current Protocols in Molecular Biology, John Wiley & Sons, New York. N.Y.), protoplast fusion, cationic liposome-mediated transfection; tungsten particle-facilitated microparticle bombardment (Johnston, Nature, 346: 776-777 (1990)); and strontium phosphate DNA co-precipitation (Brash et al., Mol. Cell Biol., 7: 2031-2034 (1987)).

III. PHARMACEUTICAL COMPOSITIONS AND FORMULATIONS

In some aspects, provided herein are compositions, such as pharmaceutical compositions and formulations for administration, that include any of the DNA-targeting systems described herein, or any of the polynucleotides or vectors encoding the same. In some aspects, the pharmaceutical composition contains one or more DNA-targeting systems provided herein or a component thereof. In some aspects, the pharmaceutical composition comprises one or more vectors, e.g., viral vectors that contain polynucleotides that encode one or more components of the DNA-targeting systems provided herein. Such compositions can be used in accord with the provided methods, and/or with the provided articles of manufacture or compositions, such as in the prevention or treatment of diseases, conditions, and disorders, or in detection, diagnostic, and prognostic methods.

The term "pharmaceutical formulation" refers to a preparation which is in such form as to permit the biological activity of an active ingredient contained therein to be effective, and which contains no additional components which are unacceptably toxic to a subject or a cell to which the formulation would be administered.

In some embodiments, the pharmaceutical composition may further comprise a pharmaceutically acceptable excipient. The pharmaceutically acceptable excipient may be functional molecules as vehicles, adjuvants, carriers, or diluents.

A "pharmaceutically acceptable carrier" refers to an ingredient in a pharmaceutical formulation, other than an active ingredient, which is nontoxic to a subject. A pharmaceutically acceptable carrier includes, but is not limited to, a buffer, excipient, stabilizer, or preservative.

In some aspects, the choice of carrier is determined in part by the particular agent and/or by the method of administration. Accordingly, there are a variety of suitable formulations. For example, the pharmaceutical composition can contain preservatives. Suitable preservatives may include, for example, methylparaben, propylparaben, sodium benzoate, and benzalkonium chloride. In some aspects, a mixture of two or more preservatives is used. The preservative or mixtures thereof are typically present in an amount of about 0.0001% to about 2% by weight of the total composition. Carriers are described, e.g., by Remington's Pharmaceutical Sciences 16th edition, Osol, A. Ed. (1980). Pharmaceutically acceptable carriers are generally nontoxic to recipients at the dosages and concentrations employed, and include, but are not limited to: buffers such as phosphate, citrate, and other organic acids; antioxidants including ascorbic acid and methionine; preservatives (such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as polyethylene glycol (PEG).

In some embodiments, the pharmaceutically acceptable excipient may be a transfection facilitating agent, which may include surface active agents, such as immune-stimulating complexes (ISCOMS), Freunds incomplete adjuvant, LPS analog including monophosphoryl lipid A, muramyl peptides, quinone analogs, vesicles such as squalene and squalene, hyaluronic acid, lipids, liposomes, calcium ions, viral proteins, polyanions, polycations, or nanoparticles, or other known transfection facilitating agents.

In some embodiments, the transfection facilitating agent is a polyanion, polycation, including poly-L-glutamate (LGS), or lipid. In some embodiments, the transfection facilitating agent is poly-L-glutamate. In some embodiments, the transfection facilitating agent may also include surface active agents such as immune-stimulating complexes (ISCOMS), Freunds incomplete adjuvant, LPS analog including monophosphoryl lipid A, muramyl peptides, quinone analogs and vesicles such as squalene and squalene, and hyaluronic acid may also be used administered in conjunction with the genetic construct. In some embodiments, the DNA vector encoding the DNA-targeting system may also include a transfection facilitating agent such as lipids, liposomes, including lecithin liposomes or other liposomes known in the art, as a DNA-liposome mixture (see for example WO9324640), calcium ions, viral proteins, polyanions, polycations, or nanoparticles, or other known transfection facilitating agents. In some embodiments, the transfection facilitating agent is a polyanion, polycation, including poly-L-glutamate (LGS), or lipid.

Compositions in some embodiments are provided as sterile liquid preparations, e.g., isotonic aqueous solutions, suspensions, emulsions, dispersions, or viscous compositions, which may in some aspects be buffered to a selected pH. Liquid preparations are normally easier to prepare than gels, other viscous compositions, and solid compositions. Additionally, liquid compositions are somewhat more convenient to administer, especially by injection. Viscous compositions, on the other hand, can be formulated within the appropriate viscosity range to provide longer contact periods with specific tissues. Liquid or viscous compositions can comprise carriers, which can be a solvent or dispersing medium containing, for example, water, saline, phosphate buffered saline, polyol (for example, glycerol, propylene glycol, liquid polyethylene glycol) and suitable mixtures thereof.

Sterile injectable solutions can be prepared by incorporating the agent in a solvent, such as in admixture with a suitable carrier, diluent, or excipient such as sterile water, physiological saline, glucose, dextrose, or the like. The formulations to be used for in vivo or ex vivo administration or use are generally sterile. Sterility may be readily accomplished, e.g., by filtration through sterile filtration membranes.

The pharmaceutical composition in some embodiments contains components in amounts effective to treat or prevent the disease or condition, such as a therapeutically effective or prophylactically effective amount. Therapeutic or prophylactic efficacy in some embodiments is monitored by periodic assessment of treated subjects. For repeated administrations over several days or longer, depending on the condition, the treatment is repeated until a desired suppression of disease symptoms occurs. However, other dosage regimens may be useful and can be determined. The desired dosage can be delivered by a single bolus administration of the composition, by multiple bolus administrations of the composition, or by continuous infusion administration of the composition.

In some embodiments, the composition can be administered to a subject by any suitable means, for example, by bolus infusion or by injection, e.g., by intravenous or subcutaneous injection. In some embodiments, a given dose is administered by a single bolus administration of the composition. In some embodiments, the composition is administered by multiple bolus administrations of the composition, for example, over a period of no more than 3 days, or by continuous infusion administration of the composition. In some embodiments, the composition is administered parenterally, for example by intravenous, intramuscular, subcutaneous, or intraperitoneal administration. In some embodiments, the composition is administered to a subject using peripheral systemic delivery by intravenous, intraperitoneal, or subcutaneous injection.

For the prevention or treatment of disease, the appropriate dosage may depend on the type of disease to be treated, the type of agent or agents, the type of cells or recombinant receptors, the severity and course of the disease, whether the agent or cells are administered for preventive or therapeutic purposes, previous therapy, the subject's clinical history and response to the agent or the cells, and the discretion of the attending physician. The compositions are in some embodiments suitably administered to the subject at one time or over a series of treatments.

IV. METHODS OF TREATMENT

Provided herein are methods of treatment, e.g., including administering any of the compositions, such as pharmaceutical compositions described herein. In some aspects, also provided are methods of administering any of the compositions described herein to a subject, such as a subject that has a disease or disorder. The compositions, such as pharmaceutical compositions, described herein are useful in a variety of therapeutic, diagnostic and prophylactic indications. For example, the compositions are useful in treating a variety of diseases and disorders in a subject (e.g., human). Such methods and uses include therapeutic methods and uses, for example, involving administration of the compositions, to a subject having a disease, condition, or disorder, such as an HBV viral infection or is associated with an HBV viral infection. In certain embodiments, the subject has been diagnosed with liver disease caused by a Hepatitis B virus infection or a Hepatitis B virus infection. In some embodiments, the HBV viral infection or the associated HBV viral infection is selected from hepatitis D virus infection, delta hepatitis, acute hepatitis B, acute fulminant hepatitis B, chronic hepatitis B, liver fibrosis, end-stage liver disease, or cancer such as hepatocellular carcinoma. The compositions are administered in an effective amount to effect treatment of the disease or disorder. Uses include uses of the compositions in such methods and treatments, and in the preparation of a medicament in order to carry out such therapeutic methods. In some embodiments, the methods are carried out by administering the compositions to the subject having or suspected of having the disease or condition. In some embodiments, the methods thereby treat the disease or condition or disorder in the subject. Also provided are therapeutic methods for administering the cells and compositions to subjects, e.g., patients.

In some embodiments, the compositions include a DNA-targeting system provided herein, or a polynucleotide or vector encoding the same, in which delivery of the composition to a subject represses transcription of one or more HBV genes and/or regulatory elements thereof resulting in silencing of HBV replication and/or HBV transcription in a subject to thereby treat a disease or condition, including chronic Hepatitis B infection. In some embodiments, administration or use of a composition that includes a DNA-targeting system provided herein, or a polynucleotide or vector encoding the same, reduces expression of one or more genes and/or regulatory elements thereof related to Hepatitis B viral replication and/or HBV transcription. In some embodiments, the Hepatitis B genes and/or regulatory elements thereof are present in a covalently closed circular (cccDNA) form, a relaxed circular DNA (rcNDA) form or are integrated into the human genomic DNA.

In some aspects, also provided herein are methods of reducing transcription of a Hepatitis B viral DNA sequence, to reduce chronic Hepatitis B infection in a subject, according to any description provided herein. In some aspects, reducing transcription of a Hepatitis B viral DNA sequence results in silencing of Hepatitis B viral replication and/or transcription. For instance, reduced transcription of the Hepatitis B viral DNA sequences results in a reduction of HBsAg transcripts and/or total HBV RNA. Reduced transcription of the Hepatitis B viral DNA sequences may also result in reduced HBsAg levels from integrated and cccDNA form and/or HBcrAg levels from cccDNA form.

In some embodiments, the methods of administering a composition containing the DNA-targeting system or a polynucleotide or vector encoding the same to a subject as provided herein are carried out in vivo (i.e. in a subject).

In some embodiments, the methods and uses for administering the DNA-targeting systems result in delivery of the DNA-targeting system to liver cells (e.g. hepatocytes). In some embodiments, the methods of administering the epigenetic-modifying DNA-targeting system (or polynucleotides or vectors for delivery of same to the liver cell(s) or compositions of any of the foregoing) to a subject contacts the DNA-targeting system with a liver cell or a population of liver cells. In some embodiments, the contacting introduces the epigenome-modifying DNA-targeting system (or polynucleotides or vectors for delivery of same to the liver cell or compositions of any of the foregoing) into the liver cell, such as where it is able to translocate or localize to the nucleus of the liver cell. In some embodiments, the methods treat an HBV infection in the liver cell or one or more liver cells in the population.

In some embodiments, the delivery to liver cells leads to an epigenetic change in the HBV gene or regulatory element, or a combination of genes or regulatory elements, which are targeted by the DNA-targeting system. In some embodiments, the epigenetic change comprises a change in at least one of: DNA accessibility, histone methylation, acetylation, phosphorylation, ubiquitylation, sumoylation, ribosylation, citrullination, and DNA methylation. In some embodiments, the epigenetic change is an altered DNA methylation of a target site in a target gene or a regulatory element thereof as described herein. In some embodiments, the epigenetic change is a histone modification of a target site in a target gene or a regulatory element thereof as described herein. In some embodiments, the delivery of the DNA-targeting system to a liver cell (e.g. hepatocyte) results in reduction of transcription of HBV genes and/or regulatory element thereof in the liver of the subject.

In some embodiments, the modifications in the HBV epigenome is by targeting a combination of genes and/or regulatory elements thereof as described herein with a provided epigenetic-modifying DNA-targeting system to change the epigenome of HBV. In some embodiments, the modified HBV includes an epigenetic change in a target site at or near a gene or regulatory element thereof involved in controlling HBC replication and/or HBV transcription, comprising polymerase gene, S-family gene, X-gene, or core family gene, or a promoter, enhancer, or a transscript processing control region. In some embodiments, the epigenetic change of any of the above target sites is a change in at least one of: DNA accessibility, histone methylation, acetylation, phosphorylation, ubiquitylation, sumoylation, ribosylation, citrullination, and DNA methylation, compared to a comparable unmodified cell (e.g. liver cell) not subjected to the method, i.e. not contacted or introduced with the DNA-targeting system described herein.

In some embodiments, the administration of the DNA-binding system modulates expression of a gene and/or regulatory element thereof or a combination of genes and/or regulatory element thereof in a liver cell, such as those described in Section I.A. In some embodiments, the gene, transcript or combination of genes and transcripts, such as those described in Section I.A, is reduced in comparison to a comparable unmodified cell (e.g. liver) not subjected to the method, i.e. not contacted or introduced with the DNA-targeting system described herein. In some embodiments, the transcription of the one or more genes is reduced by at least about 1.2-fold, 1.25-fold, 1.3-fold, 1.4-fold, 1.5-fold, 1.6-fold, 1.7-fold, 1.75-fold, 1.8-fold, 1.9-fold, 2-fold, 2.5-fold, 3-fold, 4-fold, 5-fold, 10-fold, 20-fold, 30-fold, 40-fold, 50-fold, 100-fold, 200-fold, 300-fold, 400-fold, 500-fold, 1000-fold or more. In some embodiments, generation of transcripts is reduced by at least about 1.2-fold, 1.25-fold, 1.3-fold, 1.4-fold, 1.5-fold, 1.6-fold, 1.7-fold, 1.75-fold, 1.8-fold, 1.9-fold, 2-fold, 2.5-fold, 3-fold, 4-fold, 5-fold, 10-fold, 20-fold, 30-fold, 40-fold, 50-fold, 100-fod, 200-fold, 300-fold, 400-fold, 500-fold, 1000-fold or more. In some embodiments, reduced transcription of the combination of genes and/or regulatory elements thereof reduces HBV replication and protein levels, in a subject. In some embodiments, the liver cell in the subject has been modulated to have reduced transcription of the polymerase gene, S-family gene, X-gene, or core-family gene. In some embodiments, the expression of each gene of the combination of genes in the modified liver cell is reduced by at least 1.2-fold or more compared to the expression of the same gene in a comparable unmodified liver cell, such as reduced by at or about or greater than 2-fold, 3-fold, 4-fold, 5-fold, 6-fold, 7-fold, 8-fold, 9-fold, 10-fold or more.

In some embodiments, the disease, condition, or disorder to be treated is in the liver. In some embodiments, the disease, condition, or disorder to be treated is liver disease, cancer, or viral infection. In some embodiments, the disease, condition, or disorder to be treated is hepatitis. In some embodiments, the condition to be treated is liver failure. In some embodiments, the liver failure is fulminant liver failure. In some embodiments, the disease or condition to be treated is liver cirrhosis. In some embodiments, the disease or condition to be treated is a cancer. In some embodiments, the cancer is a solid tumor cancer. In some embodiments, the cancer is hepatocellular cancer. In some embodiments, the hepatitis is acute hepatitis. In some embodiments, the hepatitis is chronic hepatitis.

In some embodiments, the subject has or is suspected of having elevated levels of HBV transcripts in the liver cells, elevated levels of HBV proteins inside and on the surface of liver cells, and elevated levels of circulating antibodies to HBV proteins. In some embodiments, the subject has or is suspected of having liver disease (e.g., hepatitis), cancer (e.g., hepatocellular carcinoma), or HBV infection (acute or chronic hepatitis).

Once the multiplexed epigenetic-modifying DNA-targeting system is administered to the subject (e.g., human), the biological activity of the modified cell populations in some aspects is measured by any of a number of known methods. Parameters to assess include reduced levels of HBV transcripts and/or HBV DNA levels in the liver cells (e.g. by qRT-PCR/qPCR), reduced levels of of HBV proteins (e.g., HBsAg, HBeAg) inside and on the surface of the liver cells (e.g., assessed by fluorescence staining and flow cytometry), and/or HBeAg, measured by analysis of blood serum using ELISA). In some aspects the biological activity is measured by assessing clinical outcome. Specific thresholds for the parameters can be set to determine the efficacy of the methods of therapy provided herein.

Also provided are methods of reducing transcription of one or more genes in a cell comprising a Hepatitis B viral sequence. In some embodiments, the method comprises introducing into the cell an epigenetic-modifying DNA-targeting system that induces targeted CpG methylation of a CpG island in a Hepatitis B viral sequence. In some embodiments, the method comprises introducing into the cell an epigenetic-modifying DNA-targeting system that induces targeted CpG methylation of CpG island 2 in a Hepatitis B viral sequence.

CpG islands are genomic regions that contain a high frequency of CG dinucleotides. Thus, these regions generally have a GC percentage that is greater than about 50% and with an observed/expected CpG ratio that is greater than about 60%. (Gardiner-Garden et al. "CpG islands in vertebrate genomes," J Mol Biol 196: 261-282 (1987)). CpG islands are often located in the vicinity of genes. Methylation comprises epigenetic methylation of cytosine residues in DNA at sites where it is not typically present in normal cells. Detection of methylation of the CpG islands can be carried out according to methods of this invention, as well as any art-known method, including, but not limited to, e.g., methylation specific-polymerase chain reaction (MS-PCR), a method of nucleic acid amplification that is well known in the art. In this assay, bisulfite modification of the DNA sequence allows the detection of differences between methylated and unmethylated alleles. Reaction of the DNA with sodium bisulfite converts all unmethylated cytosines to uracil, which is recognized as thymine by Taq polymerase, but does not affect methylated cytosines. Amplification with primers specific for methylated or unmethylated DNA discriminates between methylated and unmethylated DNA. This assay provides a simple and fast way of surveying multiple samples to detect methylation of cytosines in the region of interest (Widschwendter et al., "Methylation and silencing of the retinoic acid receptor-beta2 gene in breast cancer" J Natl. Cancer Inst. 92(10):826-832 (2000)). Other methods known in the art for detection and/or quantitative analysis of DNA methylation include, but are not limited to, the chromatin immunoprecipitation assay (ChIP) (Mulero-Navarro et al., Carcinogenesis 27:1099-1104 (2006); Nakagawachi et al., Oncogene 22:8835-8844 (2003)); MethyLight®, a bisulfite modification-dependent fluorescence-based real time PCR assay (Eads et al. Nucleic Acids Res. 28(8) e32 (2000); Erhlich et al., Oncogene 21:6694-6702 (2002)); pyrosequencing (Lee et al. Clinical Cancer Research 14:2664-2672 (2008); Dejeux et al., J. Mol. Diagn. 9:510-520 (2007)); and the Sequenom® MassARRAY® system (Sequenom, Inc., San Diego, Calif.), which utilizes MALDI-TOF mass spectrometry in combination with RNA base specific cleavage (MassCLEAVE™ kit) (Sequenom, Inc., San Diego, Calif.).

Also provided herein are methods of reducing transcription of one or more genes in a cell comprising a Hepatitis B viral sequence. In some embodiments, the method comprises introducing into the cell an epigenetic-modifying DNA-targeting system that induces targeted CpG methylation of a region within a target region corresponding to 67 bp-392 bp, 1033 bp-1749 bp, or 2215 bp-2490 bp in a Hepatitis B viral sequence with reference to nucleotide positions of SEQ ID NO: 650.

Also provided herein are methods of reducing one or more genes in a cell comprising a Hepatitis B viral sequence. In some embodiments, the method comprises introducing into the cell an epigenetic-modifying DNA-targeting system that induces targeted CpG methylation of a region within a target region corresponding to 1033 bp-1749 bp in a Hepatitis B viral sequence with reference to nucleotide positions of SEQ ID NO: 650.

Also provided herein are methods of reducing Hepatitis B virus infection in a cell comprising introducing into a cell comprising a Hepatitis B viral sequence an epigenetic-modifying DNA-targeting system that induces targeted CpG methylation of a CpG island in the Hepatitis B viral sequence.

Also provided herein are methods of reducing Hepatitis B virus infection in a cell comprising introducing into a cell comprising a Hepatitis B viral sequence an epigenetic-modifying DNA-targeting system that induces targeted CpG methylation of CpG island 2 in the Hepatitis B viral sequence.

Also provided herein are methods of reducing Hepatitis B virus infection in a cell comprising introducing into a cell comprising a Hepatitis B viral sequence an epigenetic-modifying DNA-targeting system that induces targeted CpG methylation of a region within a target region corresponding to 67 bp-392 bp, 1033 bp-1749 bp, or 2215 bp-2490 bp in a Hepatitis B viral sequence with reference to nucleotide positions of SEQ ID NO: 650.

Also provided herein are methods of reducing Hepatitis B virus infection in a cell comprising introducing into a cell comprising a Hepatitis B viral sequence an epigenetic-modifying DNA-targeting system that induces targeted CpG methylation of a region within a target region corresponding to 1033 bp −1749 bp in a Hepatitis B viral sequence with reference to nucleotide positions of SEQ ID NO: 650.

In any of the embodiments herein, the epigenetic modifying DNA-targeting system comprises at least one DNA-targeting module that comprises a fusion protein comprising (a) a DNA-binding domain for targeting a target site in a Hepatitis B viral DNA sequence; and (b) at least one effector domain comprising a DNA methyltransferase effector domain. In some embodiments, the region of CpG methylation is within 500 base pairs of the target region. In some embodiments, the introducing occurs in vivo in a subject or ex vivo. In some embodiments, the cell is a mammalian cell (e.g., human cell). In some embodiments, the cell comprises integrated HBV DNA. In some embodiments, the cell is a hepatocyte comprising a pool of episomal HBV cccDNA. In some embodiments, the hepatocyte expresses HBV proteins, such as HBsAg, and/or HBeAg.

Also provided herein are methods of promoting epigenetic modification within a target region in a Hepatitis B viral sequence, comprising introducing any of the provided epigenetic modifying DNA-targeting system that targets a target site within the target region into an HBV infected cell comprising a Hepatitis B viral sequence.

Also provided herein are methods of reducing Hepatitis virus infection in a subject comprising administering to a subject infected with Hepatitis B an epigenetic modifying DNA-targeting system that increases CpG methylation of a CpG island in a Hepatitis B viral sequence. In some embodiments, the epigenetic modifying DNA-targeting system comprises (a) a DNA-binding domain for targeting to the target site in a Hepatitis B viral DNA sequence; and (b) at least one effector domain comprising a DNA methyltransferase effector domain.

Also provided herein are methods of reducing Hepatitis virus infection in a subject comprising administering to a subject infected with Hepatitis B an epigenetic modifying DNA-targeting system that increases CpG methylation of a region within a target region in a Hepatitis B viral sequence. In some embodiments, the target region comprises CpG island 1, CpG island 2, or CpG island 3 in a Hepatitis B viral sequence. In some embodiments, the target region comprises a contiguous sequence of nucleotides within the sequence corresponding to 67 bp-392 bp, 1033 bp-1749 bp, or 2215 bp-2490 bp in a Hepatitis B viral sequence with reference to nucleotide positions of SEQ ID NO: 650. In some embodiments, the target region comprises a contiguous sequence of nucleotides within the sequence corresponding to 1255 bp-1290 bp in a Hepatitis B viral sequence with reference to nucleotide positions of SEQ ID NO: 650. In some embodiments, the epigenetic modifying DNA-targeting system comprises (a) a DNA-binding domain for targeting to the target site in a Hepatitis B viral DNA sequence; and (b) at least one effector domain comprising a DNA methyltransferase effector domain.

In any of the embodiments herein, the region of CpG methylation is within about 1000 bp, about 750 bp, about 600 bp, about 500 bp, about 450 bp, about 400 bp, about 350 bp, about 300 bp, about 250 bp, about 200 bp, about 150 bp, about 100 bp, about 50 bp of the target region.

V. KITS AND ARTICLES OF MANUFACTURE

Also provided are articles of manufacture, systems, apparatuses, and kits useful in performing the provided embodiments. In some embodiments, the provided articles of manufacture or kits contain any of the DNA-targeting systems described herein, any of the gRNAs described herein, any of the fusion proteins described herein, any of the polynucleotides described herein, any of the pluralities of polynucleotides described herein, any of the vectors described herein, any of the pluralities of vectors described herein, or a portion or a component of any of the foregoing, or any combination thereof. In some embodiments, the articles of manufacture or kits include polypeptides, polynucleotides, nucleic acids, and/or vectors useful in performing the provided methods.

In some embodiments, the articles of manufacture or kits include one or more containers, typically a plurality of containers, packaging material, and a label or package insert on or associated with the container or containers and/or packaging, generally including instructions for use, e.g., instructions for introducing or administering.

Also provided are articles of manufacture, systems, apparatuses, and kits useful in administering the provided compositions, e.g., pharmaceutical compositions, e.g., for use in therapy or treatment. In some embodiments, the articles of manufacture or kits provided herein contain vectors and/or plurality of vectors, such as any vectors and/or plurality of vectors described herein. In some aspects, the articles of manufacture or kits provided herein can be used for administration of the vectors and/or plurality of vectors, and can include instructions for use.

The articles of manufacture and/or kits containing cells or cell compositions for therapy, may include a container and a label or package insert on or associated with the container. Suitable containers include, for example, bottles, vials, syringes, IV solution bags, etc. The containers may be formed from a variety of materials such as glass or plastic. The container in some embodiments holds a composition which is by itself or combined with another composition effective for treating, preventing and/or diagnosing the condition. In some embodiments, the container has a sterile access port. Exemplary containers include an intravenous solution bags, vials, including those with stoppers pierceable by a needle for injection, or bottles or vials for orally administered agents. The label or package insert may indicate that the composition is used for treating a disease or condition. The article of manufacture may further include a package insert indicating that the compositions can be used to treat a particular condition. Alternatively, or additionally, the article of manufacture may further include another or the same container comprising a pharmaceutically-acceptable buffer. It may further include other materials such as other buffers, diluents, filters, needles, and/or syringes.

VI. DEFINITIONS

Unless defined otherwise, all terms of art, notations and other technical and scientific terms or terminology used herein are intended to have the same meaning as is commonly understood by one of ordinary skill in the art to which the claimed subject matter pertains. In some cases, terms with commonly understood meanings are defined herein for clarity and/or for ready reference, and the inclusion of such definitions herein should not necessarily be construed to represent a substantial difference over what is generally understood in the art.

As used herein, the singular forms "a," "an," and "the" include plural referents unless the context clearly dictates otherwise. For example, "a" or "an" means "at least one" or "one or more." It is understood that aspects and variations described herein include "consisting" and/or "consisting essentially of" aspects and variations.

Throughout this disclosure, various aspects of the claimed subject matter are presented in a range format. It should be understood that the description in range format is merely for convenience and brevity and should not be construed as an inflexible limitation on the scope of the claimed subject matter. Accordingly, the description of a range should be considered to have specifically disclosed all the possible sub-ranges as well as individual numerical values within that range. For example, where a range of values is provided, it is understood that each intervening value, between the upper and lower limit of that range and any other stated or intervening value in that stated range is encompassed within the claimed subject matter. The upper and lower limits of these smaller ranges may independently be included in the smaller ranges, and are also encompassed within the claimed subject matter, subject to any specifically excluded limit in the stated range. Where the stated range includes one or both of the limits, ranges excluding either or both of those included limits are also included in the claimed subject matter. This applies regardless of the breadth of the range.

The term "about" as used herein refers to the usual error range for the respective value readily known. Reference to "about" a value or parameter herein includes (and describes) embodiments that are directed to that value or parameter per se. For example, description referring to "about X" includes description of "X". In some embodiments, "about" may refer to ±25%, ±20%, ±15%, ±10%, ±5%, or ±1%.

As used herein, the term, "corresponding to" with reference to positions of a nucleotide sequence (or base pair) or protein sequence (amino acid), such as recitation that nucleotides or amino acid positions "correspond to" base pair or amino acid positions in a disclosed sequence, such as set forth in the Sequence listing, refers to nucleotides or amino acid positions identified upon alignment with the disclosed sequence to maximize identity using a standard alignment algorithm, such as the GAP algorithm. By aligning the sequences, corresponding residues can be identified, for example, using conserved and identical amino acid residues as guides. In general, to identify corresponding positions, the sequences of amino acids are aligned so that the highest order match is obtained (see, e.g.: Computational Molecular Biology, Lesk, A.M., ed., Oxford University Press, New York, 1988; Biocomputing: Informatics and Genome Projects, Smith, D.W., ed., Academic Press, New York, 1993; Computer Analysis of Sequence Data, Part I, Griffin, A. M., and Griffin, H.G., eds., Humana Press, New Jersey, 1994; Sequence Analysis in Molecular Biology, von Heinje, G., Academic Press, 1987; and Sequence Analysis Primer, Gribskov, M. and Devereux, J., eds., M Stockton Press, New York, 1991; Carrillo et al. (1988) SIAM J Applied Math 48: 1073).

A "gene," includes a DNA region encoding a gene product, as well as all DNA regions which regulate the production of the gene product, whether or not such regulatory sequences are adjacent to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions. The sequence of a gene is typically present at a fixed chromosomal position or locus on a chromosome in the cell.

A "regulatory element" or "DNA regulatory element," which terms are used interchangeably herein, in reference to a gene refers to DNA regions which regulate the production of a gene product, whether or not such regulatory sequences are adjacent to coding and/or transcribed sequences. Accordingly, a regulatory element includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions.

As used herein, a "target site" or "target nucleic acid sequence" is a nucleic acid sequence that defines a portion of a nucleic acid to which a binding molecule (e.g. a DNA-binding domain disclosed herein) will bind, provided sufficient conditions for binding exist.

The term "expression" with reference to a gene or "gene expression" refers to the conversion of the information, contained in a gene, into a gene product. A gene product can be the direct transcriptional product of a gene (e.g., mRNA, tRNA, rRNA, antisense RNA, ribozyme, structural RNA or any other type of RNA) or can be a protein produced by translation of an mRNA. Gene products also include RNAs which are modified, by processes such as capping, polyadenylation, methylation, and editing, and proteins modified by, for example, methylation, acetylation, phosphorylation, ubiquitination, ADP-ribosylation, myristoylation, and glycosylation. Hence, reference to expression or gene expression includes protein (or polypeptide) expression or expression of a transcribable product of or a gene such as mRNA. The protein expression may include intracellular expression or surface expression of a protein. Typically, expression of a gene product, such as mRNA or protein, is at a level that is detectable in the cell.

As used herein, a "detectable" expression level, means a level that is detectable by standard techniques known to a skilled artisan, and include for example, differential display, RT (reverse transcriptase)-coupled polymerase chain reaction (PCR), Northern Blot, and/or RNase protection analyses as well as immunoaffinity-based methods for protein detection, such as flow cytometry, ELISA, or western blot. The degree of expression levels need only be large enough to be visualized or measured via standard characterization techniques.

As used herein, the term "DNA-targeting system" or "epigenetic-modifying DNA-targeting system" refers to a composition comprising a DNA-binding domain (such as any Cas, ZFN, or TALE-based DNA-binding domain described herein) that targets a target site of a target gene and/or regulatory element thereof. In some embodiments, the DNA-targeting system is engineered to target the target site. In some embodiments, the DNA-targeting system comprises one or more effector domains that modify transcription of the target gene and/or regulatory element thereof when recruited to the target site by the DNA-targeting system. In some embodiments, the DNA-targeting system is capable of targeting more than one target site (i.e. a plurality of target sites), such as 2, 3, 4, 5, 6, or more target sites.

As used herein, the term "DNA-targeting module" refers to any composition or portion of a DNA-targeting system described herein that targets one target site. For example, an individual DNA-targeting module may comprise a fusion protein comprising a DNA-binding domain (e.g. a ZFN or TALE DNA-binding domain) that targets a target site for a target gene and/or regulatory element thereof, and a transcriptional repressor domain (e.g. KRAB). In other embodiments, a DNA-targeting module comprises (a) a fusion protein comprising a Cas protein and a transcriptional repressor domain, and (b) a gRNA that targets a target site of a target gene and/or regulatory element thereof. A DNA-targeting system provided herein may comprise one or more (such as two) DNA-targeting modules. A DNA-targeting system provided herein may comprise 2 to 10 DNA-targeting modules.

In some embodiments, two DNA-targeting modules of a DNA-targeting system may comprise separate, (i.e. non-overlapping) components. For example, a DNA-targeting system may comprise two different fusion proteins, each fusion protein targeting and repressing a different gene and/or regulatory element thereof. For example, the DNA-targeting system may comprise a first DNA-targeting module comprising a first fusion protein comprising a DNA-binding domain (such as a ZFN or TALE DNA-binding domain) that targets a target site for a first gene and a transcriptional repressor domain, and a second DNA-targeting module comprising a second fusion protein comprising a DNA-binding domain that targets a target site for a second gene and a transcriptional repressor domain. In another example, the DNA-targeting system may comprise a first DNA-targeting module comprising a first fusion protein comprising a DNA-binding domain that targets a target site for a first gene (such as a ZFN or TALE DNA-binding domain) and a transcriptional repressor domain, and a second DNA-targeting module comprising (a) a fusion protein comprising a Cas protein and a transcriptional repressor domain and (b) a gRNA that targets a target site for a second gene. In another example, the DNA-targeting system may comprise a first DNA-targeting module comprising a first fusion protein comprising a first Cas protein and a transcriptional repressor domain, and (b) a first gRNA that complexes with the first Cas protein and targets a target site for a first target gene, and a second DNA-targeting module comprising a second fusion protein comprising a second Cas protein that is different from the first Cas protein and a transcriptional repressor domain, and (b) a second gRNA that complexes with the second Cas protein and targets the second Cas protein to a target site for a second target gene. It will be understood that different Cas protein variants (e.g. SpCas9 and SaCas9) are compatible with different gRNA scaffold sequences and PAMs, as described herein. Thus, it is possible to engineer a single DNA-targeting system comprising multiple non-overlapping CRISPR/Cas-based DNA-targeting modules, each targeting a different target site.

In some embodiments, two DNA-targeting modules of a DNA-targeting system may comprise shared (i.e. overlapping) components. For example, a DNA-targeting system may comprise a first DNA-targeting module comprising (a)

a fusion protein comprising a Cas protein and a transcriptional repressor domain, and (b) a gRNA that targets a target site for a first gene or regulatory element thereof, and a second DNA-targeting module comprising (a) the fusion protein of the first DNA-targeting module, and (b) a gRNA that targets a target site for a second gene or regulatory element thereof. It will be understood that providing two or more different gRNAs for a given Cas protein allows different molecules of the same Cas protein to be targeted to the target sites of the two or more gRNAs.

As used herein, the term "reduced expression" or "decreased expression" means any form of expression that is lower than the expression in an original or source cell that does not contain the modification for modulating a particular gene expression by a DNA-targeting system, for instance a wild-type expression level (which can be absence of expression or immeasurable expression as well). Reference herein to "reduced expression," or "decreased expression" is taken to mean a decrease in gene expression relative to the level in a cell that does not contain the modification, such as the original source cell prior to contacting with, or engineering to introduce, the DNA-binding system into the T cell, such as an unmodified cell or a wild-type T cell. The decrease in expression can be at least 5%, 10%, 20%, 30%, 40% or 50%, 60%, 70%, 80%, 85%, 90%, or 100% or even more. In some cases, the decrease in expression can be at least 2-fold, 5-fold, 10-fold, 20-fold, 30-fold, 40-fold, 50-fold, 60-fold, 70-fold, 80-fold, 90-fold, 100-fold, 200-fold or more.

As used herein, the term "reduced transcription" or "decreased transcription" refers to the level of transcription of a gene that is lower than the transcription of the gene in an original or source cell that does not contain the modification for modulating transcription by a DNA-targeting system, for instance a wild-type transcription level of a gene. Reference to reduced transcription or decreased transcription can refer to reduction in the levels of a transcribable product of a gene such as mRNA. Any of a variety of methods can be used to monitor or quantitate a level of a transcribable product such as mRNA, including but not limited to, real-time quantitative RT (reverse transcriptase)-polymerase chain reaction (qRT-PCR), Northern Blot, microarray analysis, or RNA sequencing (RNA-Seq). The reduction in transcription can be at least 5%, 10%, 20%, 30%, 40% or 50%, 60%, 70%, 80%, 85%, 90%, or 100% or even more. In some cases, the reduction in transcription can be at least 1-fold, 2-fold, 5-fold, 10-fold, 20-fold, 30-fold, 40-fold, 50-fold, 60-fold, 70-fold, 80-fold, 90-fold, 100-fold, 200-fold or more.

As used herein, an "epigenetic modification" refers to changes in the gene expression that are not caused by changes in the DNA sequences but are due to events like DNA methylations, histone modifications, miRNA expression modulation.

As used herein, the term "modification" or "modified" with reference to a T cell refers to any change or alteration in a cell that impacts gene expression in the cell. In some embodiments, the modification is an epigenetic modification that directly changes the epigenetic state of a gene or regulatory elements thereof to alter (e.g. decrease) expression of a gene product. In some embodiments, a modification described herein results in decreased expression of a target gene or selected polynucleotide sequence.

As used herein, a "fusion" molecule is a molecule in which two or more subunit molecules are linked, such as covalently. Examples of a fusion molecule include, but are not limited to, fusion proteins (for example, a fusion between a DNA-binding domain such as a ZFP, TALE DNA-binding domain or CRISPR-Cas protein and one or more effector domains, such as a transactivation domain). The fusion molecule also may be part of a system in which a polynucleotide component associates with a polypeptide component to form a functional molecule (e.g., a CRISPR/Cas system in which a single guide RNA associates with a functional domain to modulate gene expression). Fusion molecules also include fusion nucleic acids, for example, a nucleic acid encoding the fusion protein. Expression of a fusion protein in a cell can result from delivery of the fusion protein to the cell or by delivery of a polynucleotide encoding the fusion protein to a cell, where the polynucleotide is transcribed, and the transcript is translated, to generate the fusion protein.

The term "methylation," as used herein, refers to the presence of epigenetic methylation of cytosine residues in DNA at sites where it is not typically present in normal cells.

The term "vector," as used herein, refers to a nucleic acid molecule capable of propagating another nucleic acid to which it is linked. The term includes the vector as a self-replicating nucleic acid structure as well as the vector incorporated into the genome of a host cell into which it has been introduced. Certain vectors are capable of directing the expression of nucleic acids to which they are operatively linked. Such vectors are referred to herein as "expression vectors." Among the vectors are viral vectors, such as adenoviral vectors or lentiviral vectors.

The term "expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include, but are not limited to, cosmids, plasmids (e.g., naked or contained in liposomes) and viruses (e.g., lentiviruses, retroviruses, adenoviruses, and adeno-associated viruses) that incorporate the recombinant polynucleotide.

The term "isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

The term "polynucleotide" refers to a chain of nucleotides. Furthermore, nucleic acids are polymers of nucleotides. Thus, nucleic acids and polynucleotides as used herein are interchangeable. One skilled in the art has the general knowledge that nucleic acids are polynucleotides, which can be hydrolyzed into the monomelic "nucleotides." The monomelic nucleotides can be hydrolyzed into nucleosides. As used herein polynucleotides include, but are not limited to, all nucleic acid sequences which are obtained by any means available in the art, including, without limitation, recombinant means, i.e., the cloning of nucleic acid sequences from a recombinant library or a cell genome, using ordinary cloning technology and PCR™, and the like, and by synthetic means.

As used herein, the terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. The polypeptides include natural peptides, recombinant peptides, synthetic peptides, or a combination thereof.

As used herein, "percent (%) amino acid sequence identity" and "percent identity" when used with respect to an amino acid sequence (reference polypeptide sequence) is defined as the percentage of amino acid residues in a candidate sequence (e.g., the subject antibody or fragment) that are identical with the amino acid residues in the reference polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various known ways, in some embodiments, using publicly available computer software such as BLAST, BLAST-2, ALIGN or Megalign (DNASTAR) software. Appropriate parameters for aligning sequences can be determined, including any algorithms needed to achieve maximal alignment over the full length of the sequences being compared.

In some embodiments, "operably linked" may include the association of components, such as a DNA sequence, (e.g. a heterologous nucleic acid) and a regulatory sequence(s), in such a way as to permit gene expression when the appropriate molecules (e.g. transcriptional repressor proteins) are bound to the regulatory sequence. Hence, it means that the components described are in a relationship permitting them to function in their intended manner.

An amino acid substitution may include replacement of one amino acid in a polypeptide with another amino acid. The substitution may be a conservative amino acid substitution or a non-conservative amino acid substitution. Amino acid substitutions may be introduced into a binding molecule, e.g., antibody, of interest and the products screened for a desired activity, e.g., retained/improved antigen binding, decreased immunogenicity, or improved ADCC or CDC.

Amino acids generally can be grouped according to the following common side-chain properties:
(1) hydrophobic: Norleucine, Met, Ala, Val, Leu, Ile;
(2) neutral hydrophilic: Cys, Ser, Thr, Asn, Gln;
(3) acidic: Asp, Glu;
(4) basic: His, Lys, Arg;
(5) residues that influence chain orientation: Gly, Pro;
(6) aromatic: Trp, Tyr, Phe.

In some embodiments, conservative substitutions can involve the exchange of a member of one of these classes for another member of the same class. In some embodiments, non-conservative amino acid substitutions can involve exchanging a member of one of these classes for another class.

As used herein, a composition refers to any mixture of two or more products, substances, or compounds, including cells. It may be a solution, a suspension, liquid, powder, a paste, aqueous, non-aqueous or any combination thereof.

As used herein, a "subject" or an "individual," which are terms that are used interchangeably, is a mammal. In some embodiments, a "mammal" includes humans, non-human primates, domestic and farm animals, and zoo, sports, or pet animals, such as dogs, horses, rabbits, cattle, pigs, hamsters, gerbils, mice, ferrets, rats, cats, monkeys, etc. In some embodiments, the subject or individual is human. In some embodiments, the subject is a patient that is known or suspected of having a disease, disorder or condition.

As used herein, the term "treating" and "treatment" includes administering to a subject an effective amount of cells (e.g. T cells), such as such cells that have been modified by a DNA-targeting system or polynucleotide(s) encoding the DNA-targeting system described herein, so that the subject has a reduction in at least one symptom of the disease or an improvement in the disease, for example, beneficial or desired clinical results. For purposes of this technology, beneficial or desired clinical results include, but are not limited to, alleviation of one or more symptoms, diminishment of extent of disease, stabilized (i.e., not worsening) state of disease, delay or slowing of disease progression, amelioration or palliation of the disease state, and remission (whether partial or total), whether detectable or undetectable. Treating can refer to prolonging survival as compared to expected survival if not receiving treatment. Thus, one of skill in the art realizes that a treatment may improve the disease condition, but may not be a complete cure for the disease. In some embodiments, one or more symptoms of a disease or disorder are alleviated by at least 5%, at least 10%, at least 20%, at least 30%, at least 40%, or at least 50% upon treatment of the disease.

The term "therapeutically effective amount" refers to the amount of the subject compound that will elicit the biological or medical response of a tissue, system, or subject that is being sought by the researcher, veterinarian, medical doctor or other clinician. The term "therapeutically effective amount" includes that amount of a biological molecule, such as a compound or cells, that, when administered, is sufficient to prevent development of, or alleviate to some extent, one or more of the signs or symptoms of the disorder or disease being treated. The therapeutically effective amount will vary depending on the biological molecule, the disease and its severity and the age, weight, etc., of the subject to be treated.

VII. EXEMPLARY EMBODIMENTS

Among the provided embodiments are:
1. An epigenetic-modifying DNA-targeting system comprising at least one DNA-targeting module for repressing transcription of one or more Hepatitis B viral (HBV) genes, wherein each of the at least one DNA-targeting module comprises a fusion protein comprising:
   (a) a DNA-binding domain for targeting to a target site in a Hepatitis B viral DNA sequence; and
   (b) at least one transcriptional repressor effector domain.
2. The epigenetic-modifying DNA-targeting system of embodiment 1, wherein the at least one DNA-binding domain comprises a Clustered Regularly Interspaced Short Palindromic Repeats associated (Cas)-guide RNA (gRNA) combination comprising (a) a Cas protein or a variant thereof and (b) at least one gRNA that is able to associate with the Cas protein to target the Cas protein to the target site; a zinc finger protein (ZFP); a transcription activator-like effector (TALE); a meganuclease; a homing endonuclease; or an I-SceI enzyme or a variant thereof, optionally wherein the DNA-binding domain comprises a catalytically inactive variant of any of the foregoing.

3. The epigenetic-modifying DNA-targeting system of embodiment 1 or 2, wherein the Hepatitis B viral DNA sequence is an HBV gene or a regulatory element thereof.

4. The epigenetic-modifying DNA-targeting system of any of embodiments 1-3, wherein the at least one DNA-targeting module comprises a plurality of DNA-targeting modules for targeting a plurality of target sites of one or a plurality of HBV genes or regulatory elements thereof.

5. The epigenetic-modifying DNA-targeting system of embodiment 4, wherein the plurality of DNA-targeting modules comprise at least a first DNA-targeting module and a second DNA-targeting module, wherein: (1) the first DNA-targeting module represses transcription of a first HBV gene, wherein the first DNA-targeting module comprises a first fusion protein comprising (a) a DNA-binding domain for targeting a target site of the first gene or regulatory DNA element thereof; and (b) at least one transcriptional repressor domain; and
(2) the second DNA-targeting module represses transcription of a second HBV gene, wherein the second DNA-targeting module comprises a second fusion protein comprising (a) a DNA-binding domain for targeting a target site of the second gene or regulatory DNA element thereof; and (b) at least one transcriptional repressor domain, optionally wherein:
  the first DNA-targeting module and the second DNA-targeting module share the same fusion protein such that the first and second fusion protein are the same, and wherein the DNA-binding domain of the fusion protein is a Clustered Regularly Interspaced Short Palindromic Repeats associated (Cas) protein or variant thereof that is that is able to associate with a first guide RNA (gRNA) and a second gRNA, wherein
  the first DNA-targeting module comprises the first gRNA that targets a target site of a first HBV gene or regulatory element thereof, and the second DNA-targeting module comprises the second gRNA that targets a target site of a second HBV gene or regulatory element thereof.

6. An epigenetic-modifying DNA-targeting system for repressing transcription of one or more Hepatitis B viral (HBV) genes, wherein the DNA-targeting system comprises:
(a) a fusion protein comprising a Clustered Regularly Interspaced Short Palindromic Repeats associated (Cas) protein or variant thereof and at least one transcriptional repressor effector domain; and
(b) a plurality of guide RNAs (gRNAs) comprising at least a first gRNA and a second gRNA,
wherein the first gRNA targets a target site of a first HBV gene or regulatory element thereof, and the second gRNA targets a target site of a second HBV gene or regulatory element thereof,
wherein the first and second genes or regulatory elements thereof regulate Hepatitis B virus replication and/or HBV transcription.

7. The epigenetic-modifying DNA-targeting system of embodiment 6, wherein the DNA-targeting system further comprises a third gRNA that targets a target site of a third gene or regulatory element thereof that regulates Hepatitis B virus replication and/or HBV transcription, optionally wherein the system further comprises a fourth gRNA that targets a target site of a fourth gene or regulatory element thereof, optionally a fifth gRNA that targets a fifth gene or regulatory element thereof, and/or optionally a sixth gRNA that targets a target site of a sixth gene or regulatory element thereof,
wherein the genes or regulatory element thereof regulate Hepatitis B virus replication and/or HBV transcription.

8. The epigenetic-modifying DNA-targeting system of embodiment 7, wherein the first, second, third, fourth, fifth, and/or sixth genes or regulatory elements thereof are different.

9. An epigenetic-modifying DNA-targeting system for repressing transcription of one or more Hepatitis B viral (HBV) genes, wherein the DNA-targeting system comprises:
(a) a fusion protein comprising a Clustered Regularly Interspaced Short Palindromic Repeats associated (Cas) protein or variant thereof and at least one transcriptional repressor effector domain; and
(b) a plurality of guide RNAs (gRNAs) targeting a plurality of target sites of a plurality of genes or regulatory elements thereof,
wherein the plurality of genes or regulatory elements thereof regulate Hepatitis B virus replication and/or HBV transcription.

10. An epigenetic-modifying DNA-targeting system comprising a single DNA-targeting module for repressing transcription of more than one Hepatitis B viral (HBV) genes,
wherein the DNA-targeting module comprises:
(a) a fusion protein comprising a Clustered Regularly Interspaced Short Palindromic Repeats associated (Cas) protein or variant thereof and at least one transcriptional repressor effector domain; and
(b) a guide RNAs (gRNA) targeting a plurality of target sites of a plurality of genes or regulatory elements thereof,
wherein the plurality of genes or regulatory elements thereof regulate Hepatitis B virus replication and/or HBV transcription.

11. The epigenetic-modifying DNA-targeting system of any of embodiments 1-10, wherein repressing transcription results in reduced HBV replication and/or reduced HBV protein levels.

12. The epigenetic-modifying DNA-targeting system of any of embodiments 1-11, wherein the DNA-targeting system does not introduce a genetic disruption or a DNA break.

13. The epigenetic-modifying DNA-targeting system of any of embodiments 1-9, and 11-12, wherein the at least one DNA-binding module comprises a plurality of DNA-binding modules that together target a plurality of target sites in the HBV DNA sequence, optionally wherein each DNA-binding module targets a different target site in the HBV DNA sequence.

14. The epigenetic-modifying DNA-targeting system of any of embodiments 4, 5 and 9-13, wherein the plurality of target sites are 2, 3, 4, 5, or 6 different target sites.

15. The epigenetic-modifying DNA-targeting system of any of embodiments 4, 5 and 9-14, wherein the plurality of target sites are each in a different HBV gene or a regulatory element thereof.

16. The epigenetic-modifying DNA-targeting system of any of embodiments 1-14, wherein each target site is in the same HBV gene or a regulatory element thereof.

17. The epigenetic-modifying DNA-targeting system of any of embodiments 1-5 and 11-16, wherein the system comprises 2 to 10 DNA-targeting modules.

18. The epigenetic-modifying DNA-targeting system of any of embodiments 1-5 and 11-17, wherein any two or more of the DNA-targeting modules share the same fusion protein or wherein any two or more of the DNA-targeting modules comprise different fusion proteins.

19. The epigenetic-modifying DNA-targeting system of any of embodiments 1-5 and 11-18, wherein the DNA-binding domain of each DNA-targeting module comprises a fusion protein comprising a Clustered Regularly Interspaced Short Palindromic Repeats associated (Cas) protein or variant thereof and at least one transcriptional repressor effector domain and wherein each DNA-targeting module comprises a unique gRNA.

20. The epigenetic-modifying DNA-targeting system of any of embodiments 1-19, wherein the target site, or each of the target sites, is present in a covalently closed circular DNA (cccDNA) form, relaxed circular DNA (rcDNA) form and/or is in HBV viral DNA integrated in the human genomic DNA.

21. The epigenetic-modifying DNA-targeting system of any of embodiments 1-20, wherein the target site, or each of the target sites, is present at or near a gene or a regulatory element thereof involved in controlling HBV replication and/or HBV transcription.

22. The epigenetic-modifying DNA-targeting system of embodiment 21, wherein the gene involved in controlling HBV replication and/or HBV transcription encodes a polymerase, an envelope protein, capsid protein, transcription factor, or transcriptional transactivator.

23. The epigenetic-modifying DNA-targeting system of embodiment 21 or embodiment 22, wherein the gene involved in controlling HBV replication and/or HBV transcription is a polymerase gene, S-family gene, X-gene, or core family gene.

24. The epigenetic-modifying DNA-targeting system of any of embodiments 1-23, wherein at least one target site is in gene or regulatory element thereof of the X-gene encoding Hepatitis B Virus Protein X (HBx).

25. The epigenetic-modifying DNA-targeting system of any of embodiments 1-24, wherein the target site, or each of the target sites, is at or near a regulatory element of the HBV gene involved in controlling HBV replication and/or HBV transcription.

26. The epigenetic-modifying DNA-targeting system of embodiment 25, wherein the regulatory element is a promoter region.

27. The epigenetic-modifying DNA-targeting system of embodiment 26, wherein the promoter region is a pre-S1 promoter, a pre-S2 promoter, X promoter, or basal core promoter.

28. The epigenetic-modifying DNA-targeting system of embodiment 25, wherein the regulatory element is an enhancer region.

29. The epigenetic-modifying DNA-targeting system of embodiment 28, wherein the enhancer region is an Enh1 or an Enh2 enhancer region.

30. The epigenetic-modifying DNA-targeting system of embodiment 25, wherein the regulatory element is a transcript processing control region.

31. The epigenetic-modifying DNA-targeting system of any of embodiments 1-24, wherein the target site, or each of the target sites, is in a coding region of an HBV gene.

32. The epigenetic-modifying DNA-targeting system of any of embodiments 1-31, wherein the target site, or each of the target sites, is located within 500 base pairs (bp), within 1000 bp, within 1500 bp of a transcription start site.

33. The epigenetic-modifying DNA-targeting system of any of embodiments 1-32, wherein the target site, or each of the target sites, is positioned within a target region that is located at base pairs between 0-3300 base pairs (bp) of the HBV genome, optionally between 0-3182 bp corresponding to positions with reference to the HBV genome set forth in SEQ ID NO: 650.

34. The epigenetic-modifying DNA-targeting system of any of embodiments 1-33, wherein the target site, or each of the target sites, is positioned within a target region that has a sequence corresponding to the sequence located at base pairs between 43 bp-490 bp, 1033 bp-1749 bp, 1800 bp-1950 bp, or 2953 bp-3182 bp of the HBV genome with reference to the HBV genome set forth in SEQ ID NO: 650.

35. The epigenetic-modifying DNA-targeting system of any of embodiments 1-33, wherein the target site, or each of the target sites, is positioned within a target region that has a sequence corresponding to the sequence located at base pairs between 1 bp-42 bp, 491 bp-1032 bp, 1750 bp-1799 bp, or 1951 bp-2952 bp of the HBV genome with reference to the HBV genome set forth in SEQ ID NO: 650.

36. The epigenetic-modifying DNA-targeting system of any of embodiments 1-33, wherein the target site, or each of the target sites, is in a CpG island of the HBV genome.

37. The epigenetic-modifying DNA-targeting system of any of embodiments 1-33 and 36, wherein the target site, or each of the target sites, is positioned within a target region that has a sequence corresponding to the sequence located at base pairs between 67 bp-392 bp, 1033 bp-1749 bp, or 2215 bp-2490 bp of the HBV genome with reference to the HBV genome set forth in SEQ ID NO: 650.

38. The epigenetic-modifying DNA-targeting system of any of embodiments 1-33, 36 and 37, wherein the target site, or each of the target sites, is positioned within a target region that has a sequence corresponding to the sequence located at base pairs between 1033 bp-1749 bp in a Hepatitis B viral sequence with reference to nucleotide positions of SEQ ID NO: 650.

39. The epigenetic-modifying DNA-targeting system of any of embodiments 1-37, wherein the target site, or each of the target sites, is within a target region located within 300 base pairs upstream of the hepatitis B X protein (HBx) start codon.

40. An epigenetic-modifying DNA-targeting system comprising at least one DNA-targeting module for repressing transcription of one or more Hepatitis B viral (HBV) genes, wherein each of the at least one DNA-targeting module comprises a fusion protein comprising:

(a) a DNA-binding domain for targeting to a target site within a target region spanning within 300 base pairs upstream of the hepatitis B X protein (HBx) start codon; and (b) at least one transcriptional repressor effector domain.

41. The epigenetic-modifying DNA-targeting system of any of embodiments 1-40, wherein the target site, or each of the target sites, is positioned in the HBx basal core promoter region.

42. The epigenetic-modifying DNA-targeting system of any of embodiments 1-40, wherein the target site, or each of the target sites, is positioned within the HBx promoter/Enhancer region.

43. The epigenetic-modifying DNA-targeting system of any of embodiments 1-42, wherein the target site, or each of the target sites, is within a target region spanning within 250 base pairs upstream of the hepatitis B X protein (HBx) start codon.

44. The epigenetic-modifying DNA-targeting system of any of embodiments 1-43, wherein the target site, or each of the target sites, is within a target region that has a sequence corresponding to the sequence located at base pairs between 1060-1480 bp of the HBV genome with reference to the HBV genome set forth in SEQ ID NO: 650.

45. The epigenetic-modifying DNA-targeting system of any of embodiments 1-44, wherein the target site, or each of the target sites, is within a target region spanning within 150 base pairs upstream of the hepatitis B X protein (HBx) start codon.

46. The epigenetic-modifying DNA-targeting system of any of embodiments 1-45, wherein the target site, or each of the target sites, is within a target region spanning within 120 base pairs upstream of the hepatitis B X protein (HBx) start codon.

47. The epigenetic-modifying DNA-targeting system of any of embodiments 1-46, wherein the target site, or each of the target sites, is within a target region that has a sequence corresponding to the sequence located at base pairs between 1250-1374 bp of the HBV genome with reference to the HBV genome set forth in SEQ ID NO: 650.

48. The epigenetic-modifying DNA-targeting system of any of embodiments 1-47, wherein the target site, or each of the target sites, is within a target region that has a sequence corresponding to the sequence located at base pairs between 1255-1302 bp of the HBV genome with reference to the HBV genome set forth in SEQ ID NO: 650.

49. The epigenetic-modifying DNA-targeting system of any of embodiments 1-48, wherein the target site, or each of the target sites, is within a target region that has a sequence corresponding to the sequence located at base pairs between 1260-1300 bp of the HBV genome with reference to the HBV genome set forth in SEQ ID NO: 650.

50. The epigenetic-modifying DNA-targeting system of any of embodiments 1-49, wherein the target site, or each of the target sites, is at least 70% homologous to all Hepatitis B viral genomes.

51. The epigenetic-modifying DNA-targeting system of any of embodiments 1-50, wherein the target site, or each of the target sites, is at least 70% homologous to at least 1000 Hepatitis B viral genomes.

52. The epigenetic-modifying DNA-targeting system of any of embodiments 1-51, wherein the target site, or each of the target sites, is at least 70% homologous to at least 1000 Hepatitis B viral genomes and comprises up to two mismatches.

53. The epigenetic-modifying DNA-targeting system of any of embodiments 1-52, wherein the target site, or each of the target sites, comprises the sequence set forth in any one of SEQ ID NOS: 1-195, a contiguous portion thereof of at least 14 nucleotides (nt), or a complementary sequence of any of the foregoing.

54. The epigenetic-modifying DNA-targeting system of any of embodiments 1-53, wherein the target site, or each of the target sites comprises the sequence set forth in any one of SEQ ID NOs: 175, 138, 192, 152, 118, 125, 185, 63, 116, 124, 35, 82, a contiguous portion thereof of at least 14 nucleotides (nt), or a complementary sequence of any of the foregoing.

55. The epigenetic-modifying DNA-targeting system of any of embodiments 1-54, wherein the target site, or each of the target sites comprises the sequence set forth in any one of SEQ ID NOs: 175, 138, 192, 152, 118, 125, 185, 63, 116, 124, 35, 82.

56. The epigenetic-modifying DNA-targeting system of any of embodiments 1-53, wherein the target site, or each of the target sites comprises the sequence set forth in any one of SEQ ID NOs: 5, 6, 12, 18, 22, 26, 29, 38, 42, 43, 51, 56, 61, 63, 68, 72, 75, 79, 82, 84, 88, 89, 98, 99, 113, 116, 121, 124, 125, 118, 130, 133, 135, 138, 143, 150, 152, 155, 158, 164, 165, 175, 176, 182, 185, 189, 190, 192, a contiguous portion thereof of at least 14 nucleotides (nt), or a complementary sequence of any of the foregoing.

57. The epigenetic-modifying DNA-targeting system of any of embodiments 1-53 and 56, wherein the target site, or each of the target sites comprises the sequence set forth in any one of SEQ ID NOs: 5, 6, 12, 18, 22, 26, 29, 38, 42, 43, 51, 56, 61, 63, 68, 72, 75, 79, 82, 84, 88, 89, 98, 99, 113, 116, 121, 124, 125, 118, 130, 133, 135, 138, 143, 150, 152, 155, 158, 164, 165, 175, 176, 182, 185, 189, 190, 192.

58. The epigenetic-modifying DNA-targeting system of any of embodiments 1-53 and 58, wherein the target site, or each of the target sites, is set forth in any one of SEQ ID NOS: 12, 18, 20, 22, 26, 27, 46, 50, 63, 66, 73, 79, 185, 192, a contiguous portion thereof of at least 14 nucleotides, or a complementary sequence of any of the foregoing.

59. The epigenetic-modifying DNA-targeting system of any of embodiments 1-53 and 58, wherein the target site, or each of the target sites, is set forth in any one of SEQ ID NOS: 12, 18, 20, 22, 26, 27, 46, 50, 63, 66, 73, 79, 185, 192.

60. The epigenetic-modifying DNA-targeting system of any of embodiments 1-53 and 56-59, wherein the target site, or each of the target sites, comprises the sequence set forth in SEQ ID NO: 22, a contiguous portion thereof of at least 14 nucleotides, or a complementary sequence of any of the foregoing, optionally wherein the target site is set forth in SEQ ID NO: 22.

61. The epigenetic-modifying DNA-targeting system of any of embodiments 1-53 and 56-59, wherein the target site, or each of the target sites, comprises the sequence set forth in SEQ ID NO: 63, a contiguous portion thereof of at least 14 nucleotides, or a complementary sequence of any of the foregoing, optionally wherein the target site is set forth in SEQ ID NO: 63.

62. The epigenetic-modifying DNA-targeting system of any of embodiments 2-53, wherein the gRNA, or each of the gRNA, comprises a gRNA spacer sequence comprising the sequence set forth in any one of SEQ ID NOs: 196-390.

63. The epigenetic-modifying DNA-targeting system of embodiment 62, wherein the gRNA, or each of the gRNA further comprises the sequence set forth in SEQ ID NO: 587.

64. The epigenetic-modifying DNA-targeting system of any of embodiments 2-53, 62 and 63, wherein the gRNA, or each of the gRNA, comprises the sequence set forth in any one of SEQ ID NOS: 391-585.

65. The epigenetic-modifying DNA-targeting system of any of embodiments 2-53, and 62-64, wherein the gRNA, or each of the gRNA, is set forth in any one of SEQ ID NOS: 391-585.

66. The epigenetic-modifying DNA-targeting system of any of embodiments 2-53 and 62-64, wherein the gRNA, or each of the gRNA, comprises the sequence set forth in any one of SEQ ID NOS: 370, 333, 387, 347, 313, 320, 380, 256, 258, 311, 319, 230, 272, a contiguous portion thereof of at least 14 nucleotides, or a complementary sequence of any of the foregoing, optionally wherein the gRNA, or each of the gRNA, is set forth in any one of SEQ ID NOS: 565, 528, 542, 508, 515, 575, 515, 453, 506, 514, 425, or 472.

67. The epigenetic-modifying DNA-targeting system of any of embodiments 2-53 and 62-66, wherein the gRNA, or each of the gRNA, comprises the sequence set forth in any one of SEQ ID NOS: 370, 333, 387, 347, 313, 320, 380, 256, 258, 311, 319, 230, 272, optionally wherein the gRNA, or each of the gRNA, is set forth in any one of SEQ ID NOS: 565, 528, 542, 508, 515, 575, 515, 453, 506, 514, 425, or 472.

68. The epigenetic-modifying DNA-targeting system of any of embodiments 2-53 and 62-65, wherein the gRNA, or each of the gRNA, comprises the sequence set forth in any one of SEQ ID NOS: 200, 201, 207, 217, 221, 224, 233, 237, 238, 246, 251, 256, 258, 263, 267, 274, 270, 277, 279, 283, 284, 293, 294, 308, 311, 313, 316, 319, 320, 325, 328, 330, 333, 338, 345, 347, 350, 353, 359, 360, 370, 371, 377, 380, 384, 385, 387, a contiguous portion thereof of at least 14 nucleotides, or a complementary sequence of any of the foregoing, optionally wherein the gRNA, or each of the gRNA, is set forth in any one of SEQ ID NOS: 395, 402, 408, 412, 416, 419, 428, 432, 433, 441, 446, 451, 453, 458, 462, 465, 469, 472, 474, 478, 479, 488, 489, 503, 506, 508, 511, 514, 515, 520, 523, 525, 575, 528, 533, 540, 542, 545, 548, 554, 555, 565, 566, 572, 579, 580, or 582.

69. The epigenetic-modifying DNA-targeting system of any of embodiments 2-53, 62-65 and 68, wherein the gRNA, or each of the gRNA, comprises the sequence set forth in any one of SEQ ID NOS: 200, 201, 207, 217, 221, 224, 233, 237, 238, 246, 251, 256, 258, 263, 267, 274, 270, 277, 279, 283, 284, 293, 294, 308, 311, 313, 316, 319, 320, 325, 328, 330, 333, 338, 345, 347, 350, 353, 359, 360, 370, 371, 377, 380, 384, 385, or 387, optionally wherein the gRNA, or each of the gRNA, is set forth in any one of SEQ ID NOS:395, 402, 408, 412, 416, 419, 428, 432, 433, 441, 446, 451, 453, 458, 462, 465, 469, 472, 474, 478, 479, 488, 489, 503, 506, 508, 511, 514, 515, 520, 523, 525, 575, 528, 533, 540, 542, 545, 548, 554, 555, 565, 566, 572, 579, 580, or 582.

70. The epigenetic-modifying DNA-targeting system of any of embodiments 2-53 and 62-65, wherein the gRNA, or each of the gRNA, comprises the sequence set forth in any one of SEQ ID NOS: 207, 213, 215, 217, 221, 222, 241, 245, 258, 261, 268, 274, 380, 387, a contiguous portion thereof of at least 14 nucleotides, or a complementary sequence of any of the foregoing, optionally wherein the gRNA, or each of the gRNA, is set forth in any one of SEQ ID NOS: 402, 408, 410, 412, 416, 417, 436, 440, 453, 456, 463, 469, 575, 582.

71. The epigenetic-modifying DNA-targeting system of any of embodiments 2-53, 62-65 and 70, wherein the gRNA, or each of the gRNA, comprises the sequence set forth in any one of SEQ ID NOS: 207, 213, 215, 217, 221, 222, 241, 245, 258, 261, 268, 274, 380, 387, optionally wherein the gRNA, or each of the gRNA, is set forth in any one of SEQ ID NOS: 402, 408, 410, 412, 416, 417, 436, 440, 453, 456, 463, 469, 575, 582.

72. The epigenetic-modifying DNA-targeting system of any of embodiments 2-53, 62-65 and 68-71, wherein the gRNA, or each of the gRNA, comprises the sequence set forth in SEQ ID NO: 217, a contiguous portion thereof of at least 14 nucleotides, or a complementary sequence of any of the foregoing, optionally wherein the gRNA, or each of the gRNA, comprises the sequence set forth in SEQ ID NO: 217, optionally wherein the gRNA, or each of the gRNA, is set forth in any one of SEQ ID NO: 412.

73. The epigenetic-modifying DNA-targeting system of any of embodiments 2-53, 62-65 and 68-71, wherein the gRNA, or each of the gRNA, comprises the sequence set forth in SEQ ID NO: 258, a contiguous portion thereof of at least 14 nucleotides, or a complementary sequence of any of the foregoing, optionally wherein the gRNA, or each of the gRNA, comprises the sequence set forth in SEQ ID NO: 258, optionally wherein the gRNA, or each of the gRNA, is set forth in any one of SEQ ID NO: 453.

74. The epigenetic-modifying DNA-targeting system of any of embodiments 1-73, wherein the target site, or each of the target sites, is at least 90% homologous to all Hepatitis B viral genomes.

75. The epigenetic-modifying DNA-targeting system of any of embodiments 1-74 wherein the target site, or each of the target sites, is at least 90% homologous to at least 1000 Hepatitis B viral genomes.

76. The epigenetic-modifying DNA-targeting system of any of embodiments 1-75, wherein the target site, or each of the target sites, is at least 90% homologous to at least 1000 Hepatitis B viral genomes and comprises up to two mismatches, optionally one or two mismatches.

77. The epigenetic-modifying DNA-targeting system of any of embodiments 1-53, 62-65 and 74-76, wherein the target site, or each of the target sites, comprises a sequence set forth in any one of SEQ ID NOS: 35-100, a contiguous portion thereof of at least 14 nucleotides (nt), or a complementary sequence of any of the foregoing.

78. The epigenetic-modifying DNA-targeting system of any of embodiments 2-53, 62-65 and 74-77, wherein the gRNA, or each of the gRNA, comprises a gRNA spacer sequence comprising the sequence set forth in any one of SEQ ID NOs: 230-295.

79. The epigenetic-modifying DNA-targeting system of embodiment 78, wherein the gRNA, or each of the gRNA, further comprises the sequence set forth in SEQ ID NO: 587.

80. The epigenetic-modifying DNA-targeting system of any of embodiments 2-53, 62-65, and 74-79, wherein the gRNA, or each of the gRNA, comprises the sequence set forth in any one of SEQ ID NOs: 230-295, optionally wherein the gRNA or each of the gRNA is set forth in any one of SEQ ID NOs: 425-490.

81. The epigenetic-modifying DNA-targeting system of any of embodiments 52-80, wherein the up to two mismatches are located in the first 12 nt on the 5' end of the gRNA protospacer.

82. The epigenetic-modifying DNA-targeting system of any of embodiments 1-51 and 53-73, 75, and 77-81, wherein the target site, or each of the target sites, is at least 90% homologous to at least 1000 Hepatitis B viral genomes and comprises zero mismatches.

83. The epigenetic-modifying DNA-targeting system of any of embodiments 1-53, 62-65, 74-76 and 82, wherein the target site comprises the sequence set forth in any one of SEQ ID NOS: 1-34, a contiguous portion thereof of at least 14 nucleotides (nt), or a complementary sequence of any of the foregoing.

84. The epigenetic-modifying DNA-targeting system of any of embodiments 2-53, 62-65, 74-76, 82 and 83, wherein the gRNA, or each of the gRNA, comprises a gRNA spacer sequence comprising the sequence set forth in SEQ ID NO: 196-229.

85. The epigenetic-modifying DNA-targeting system of any of embodiments 62-84, wherein the gRNA spacer sequence is between 14 nt and 24 nt, or between 16 nt and 22 nt in length.

86. The epigenetic-modifying DNA-targeting system of any of embodiments 62-85, wherein the gRNA spacer sequence is 18 nt, 19 nt, 20 nt, 21 nt or 22 nt in length.

87. The epigenetic-modifying DNA-targeting system of any of embodiments 62-86, wherein the gRNA spacer sequence comprises modified nucleotides for increased stability.

88. The epigenetic-modifying DNA-targeting system of any of embodiments 2-53, 62, 74-76, and 82-87, wherein the at least one gRNA further comprises the sequence set forth in SEQ ID NO: 587.

89. The epigenetic-modifying DNA-targeting system of any of embodiments 2-53, 62, 74-76, and 82-88, wherein the gRNA, or each of the gRNA, comprises the sequence set forth in any one of SEQ ID NOS: 196-229, optionally wherein the gRNA, or each of the gRNA, is set forth in any one of SEQ ID NOS: 391-424.

90. The epigenetic-modifying DNA-targeting system of any of embodiments 2-53, 62, 74-76 and 82-89, wherein the gRNA, or each of the gRNA, comprises the sequence set forth in any one of SEQ ID NOS: 207, 213, 215, 217, 221, 222, 241, 245, 258, 261, 268, 274, 380, 387, optionally wherein the gRNA, or each of the gRNA, is set forth in any one of SEQ ID NOS: 402, 408, 410, 412, 416, 417, 436, 440, 453, 456, 463, 469, 575, 582.

91. The epigenetic-modifying DNA-targeting system of any of embodiments 2-53, 62, 74-76 and 82-90, wherein the gRNA comprises the sequence set forth in SEQ ID NO: 217, optionally wherein the gRNA, is set forth in SEQ ID NO: 412.

92. The epigenetic-modifying DNA-targeting system of any one of embodiments 2-91, wherein the Cas protein or a variant thereof is a Cas9 protein or a variant thereof.

93. The epigenetic-modifying DNA-targeting system of any one of embodiments 2-92, wherein the Cas protein or a variant thereof is a Cas12 protein or a variant thereof.

94. The epigenetic-modifying DNA-targeting system of any one of embodiments 2-93, wherein the Cas protein or a variant thereof is a variant Cas protein, wherein the variant Cas protein lacks nuclease activity or is a deactivated Cas (dCas) protein.

95. The epigenetic-modifying DNA-targeting system of any one of embodiments 2-94, wherein the variant Cas protein is a variant Cas9 protein that lacks nuclease activity or that is a deactivated Cas9 (dCas9) protein.

96. The epigenetic-modifying DNA-targeting system of any one of embodiments 2-95, wherein the Cas9 protein or a variant thereof is a Staphylococcus aureus Cas9 (SaCas9) protein or a variant thereof.

97. The epigenetic-modifying DNA-targeting system of embodiment 96, wherein the variant Cas9 is a Staphylococcus aureus dCas9 protein (dSaCas9) that comprises at least one amino acid mutation selected from D10A and N580A, with reference to numbering of positions of SEQ ID NO: 596.

98. The epigenetic-modifying DNA-targeting system of embodiment 96 or 97, wherein the variant Cas9 protein comprises the sequence set forth in SEQ ID NO: 597, or an amino acid sequence that has at least 90%, 91%, 92%, 93%, 94%, 95%, 96%, 97%, 98%, or 99% sequence identity to SEQ ID NO: 597.

99. The epigenetic-modifying DNA-targeting system of any one of embodiments 2-95, wherein the Cas9 protein or a variant thereof is a Streptococcus pyogenes Cas9 (SpCas9) protein or a variant thereof.

100. The epigenetic-modifying DNA-targeting system of embodiment 99, wherein the variant Cas9 is a Streptococcus pyogenes dCas9 (dSpCas9) protein that comprises at least one amino acid mutation selected from D10A and H840A, with reference to numbering of positions of SEQ ID NO: 598.

101. The epigenetic-modifying DNA-targeting system of embodiment 99 or 100, wherein the variant Cas9 protein comprises the sequence set forth in SEQ ID NO:599 or an amino acid sequence that has at least 90%, 91%, 92%, 93%, 94%, 95%, 96%, 97%, 98%, or 99% sequence identity thereto.

102. The epigenetic-modifying DNA-targeting system of any of embodiments 1-5, 11-18, 20-33, 34-61, wherein the at least one DNA-binding domain comprises an engineered zinc finger protein (eZFP).

103. The epigenetic-modifying DNA-targeting system of any of embodiments 1-5, 11-18, 20-33, 34-61 and 102, wherein the at least one DNA-binding domain is an eZFP.

104. The epigenetic-modifying DNA-targeting system of any of embodiments 1-54, 11-18, 20-33, 34-61, 102 and 103, wherein the target site comprises the nucleotide sequence set forth in any one of SEQ ID NOS: 1045, 1046, 1052, a contiguous portion thereof of at least 12 nt, or a complementary sequence of any of the foregoing.

105. The epigenetic-modifying DNA-targeting system of any of embodiments 1-54, 11-18, 20-33, 34-61 and 102-104, wherein the target site comprises the nucleotide sequence set forth in any one of SEQ ID NOS: 1045, 1046, 1052.

106. The epigenetic-modifying DNA-targeting system of any of embodiments 102-105, wherein the zinc finger protein comprises six zinc fingers denoted F1 through F6 in order from N-terminus to C-terminus, and wherein the amino acid sequence of each zinc finger recognition region is as follows:

1)
F1: SEADRSR (SEQ ID NO: 720)
F2: DRSNLTR (SEQ ID NO: 721)
F3: QSSDLSR (SEQ ID NO: 722)
F4: YHWYLKK (SEQ ID NO: 723)
F5: RSDSLSV (SEQ ID NO: 724)
F6: QNANRKT; (SEQ ID NO: 725)

2)
F1: RSDVLST (SEQ ID NO: 726)
F2: DNSSRTR (SEQ ID NO: 727)
F3: RPYTLRL (SEQ ID NO: 728)
F4: DSSHRTR (SEQ ID NO: 729)
F5: RSDHLSQ (SEQ ID NO: 730)
F6: DSSHRTR; (SEQ ID NO: 731)

3)
F1: RSDHLSQ (SEQ ID NO: 732)
F2: QSADRTK (SEQ ID NO: 733)
F3: RSDHLSQ (SEQ ID NO: 734)
F4: RRSDLKR (SEQ ID NO: 735)
F5: RSDHLSR (SEQ ID NO: 736)
F6: QSSDLRR; (SEQ ID NO: 737)

4)
F1: RSDNLSE (SEQ ID NO: 738)
F2: TSSNRKT (SEQ ID NO: 739)
F3: DRSHLTR (SEQ ID NO: 740)
F4: RSDALTQ (SEQ ID NO: 741)
F5: DRSALAR (SEQ ID NO: 742)
F6: RRFTLSK; (SEQ ID NO: 743)

5)
F1: RSDHLSE (SEQ ID NO: 744)
F2: QYSGRYY (SEQ ID NO: 745)
F3: HGQTLNE (SEQ ID NO: 746)
F4: QSGNLAR (SEQ ID NO: 747)
F5: RSDSLLR (SEQ ID NO: 748)
F6: CREYRGK; (SEQ ID NO: 749)

6)
F1: QSANRTT (SEQ ID NO: 750)
F2: RSANLTR (SEQ ID NO: 751)
F3: RSDVLSE (SEQ ID NO: 752)
F4: TSGHLSR (SEQ ID NO: 753)
F5: QSSDLSR, (SEQ ID NO: 754)
F6: QWSTRKR; (SEQ ID NO: 755)

7)
F1: QSGNLAR (SEQ ID NO: 756)
F2: ATCCLAH (SEQ ID NO: 757)

F3:
RWQYLPT (SEQ ID NO: 758)

F4:
DRSALAR (SEQ ID NO: 759)

F5:
RSDNLSE (SEQ ID NO: 760)

F6:
KRCNLRC; (SEQ ID NO: 761)

8)
F1:
NPANLTR (SEQ ID NO: 762)

F2:
QNATRTK (SEQ ID NO: 763)

F3:
QSGHLAR (SEQ ID NO: 764)

F4:
NRHDRAK (SEQ ID NO: 765)

F5:
RSDHLSE, (SEQ ID NO: 766)

F6:
QRRSRYK; (SEQ ID NO: 767)

9)
F1:
QSSDLSR (SEQ ID NO: 768)

F2:
HRSTRNR (SEQ ID NO: 769)

F3:
RSDVLSA (SEQ ID NO: 770)

F4:
DSRTRKN (SEQ ID NO: 771)

F5:
QSGSLTR (SEQ ID NO: 772)

F6:
DQSGLAH; (SEQ ID NO: 773)

10)
F1:
QNPAQWR (SEQ ID NO: 774)

F2:
RSADLSR (SEQ ID NO: 775)

F3:
TSGSLSR (SEQ ID NO: 776)

F4:
RSDHLSR (SEQ ID NO: 777)

F5:
RSDSLLR (SEQ ID NO: 778)

F6:
QSYDRFQ; (SEQ ID NO: 779)

11)
F1:
TSGSLSR (SEQ ID NO: 780)

F2:
RSDHLSR (SEQ ID NO: 781)

F3:
RSDSLLR (SEQ ID NO: 782)

F4:
QSYDRFQ (SEQ ID NO: 783)

F5:
RSDNLST (SEQ ID NO: 784)

F6:
DNRDRIK; (SEQ ID NO: 785)

12)
F1:
DRSNLSR (SEQ ID NO: 786)

F2:
LRQNLIM (SEQ ID NO: 787)

F3:
ERGTLAR (SEQ ID NO: 788)

F4:
RSDALTQ (SEQ ID NO: 789)

F5:
RSDSLSQ (SEQ ID NO: 790)

F6:
RKADRTR; (SEQ ID NO: 791)

13)
F1:
QYCCLTN (SEQ ID NO: 792)

F2:
TSGNLTR (SEQ ID NO: 793)

F3:
QSSDLSR (SEQ ID NO: 794)

F4:
FRYYLKR (SEQ ID NO: 795)

-continued

F5:
QSGDLTR (SEQ ID NO: 796)

F6:
DKGNLTK; (SEQ ID NO: 797)

14)
F1:
TSGSLSR (SEQ ID NO: 798)

F2:
RSDNLTT (SEQ ID NO: 799)

F3:
QSGNLAR (SEQ ID NO: 800)

F4:
DRTTLMR (SEQ ID NO: 801)

F5:
QSGHLAR (SEQ ID NO: 802)

F6:
QLTHLNS; (SEQ ID NO: 803)

15)
F1:
IKHDLHR (SEQ ID NO: 804)

F2:
RSANLTR (SEQ ID NO: 805)

F3:
RSDNLAR (SEQ ID NO: 806)

F4:
QNVSRPR (SEQ ID NO: 807)

F5:
RSDDLSK (SEQ ID NO: 808)

F6:
DSSHRTR; (SEQ ID NO: 809)

16)
F1:
RSDNLAR (SEQ ID NO: 810)

F2:
QNVSRPR (SEQ ID NO: 811)

F3:
RSDDLSK (SEQ ID NO: 812)

F4:
DSSHRTR (SEQ ID NO: 813)

F5:
TSSNRKT (SEQ ID NO: 814)

F6:
AQWTRAC; (SEQ ID NO: 815)

17)
F1:
RSDDLSK (SEQ ID NO: 816)

F2:
DSSHRTR (SEQ ID NO: 817)

F3:
TSSNRKT (SEQ ID NO: 818)

F4:
AQWTRAC (SEQ ID NO: 819)

F5:
RKQTRTT (SEQ ID NO: 820)

F6:
HRSSLRR; (SEQ ID NO: 821)

18)
F1:
QSAHRKN (SEQ ID NO: 822)

F2:
TSSNRKT (SEQ ID NO: 823)

F3:
RSDNLSA (SEQ ID NO: 824)

F4:
RNNDRKT (SEQ ID NO: 825)

F5:
TSGSLSR (SEQ ID NO: 826)

F6:
QAGHLAK; (SEQ ID NO: 827)

19)
F1:
RSDHLSQ (SEQ ID NO: 828)

F2:
ASSTRTK (SEQ ID NO: 829)

F3:
RSDDLTR (SEQ ID NO: 830)

F4:
QKSNLSS (SEQ ID NO: 831)

F5:
QSANRTT (SEQ ID NO: 832)

F6:
QNATRTK; (SEQ ID NO: 833)

20)
F1:
RSDTLSE (SEQ ID NO: 834)

F2:
RRWTLVG (SEQ ID NO: 835)

F3:
DRSNLSR (SEQ ID NO: 836)

F4:
QSGDLTR (SEQ ID NO: 837)

F5:
QSSDLSR (SEQ ID NO: 838)

F6:
YHWYLKK; (SEQ ID NO: 839)

21)
F1:
RSANLAR (SEQ ID NO: 840)

F2:
RSDNLRE (SEQ ID NO: 841)

F3:
RPYTLRL (SEQ ID NO: 842)

F4:
HRSNLNK (SEQ ID NO: 843)

F5:
QSGSLTR (SEQ ID NO: 844)

F6:
TSANLSR; (SEQ ID NO: 845)

22)
F1:
RSDDLVR (SEQ ID NO: 846)

F2:
TSGSLVR (SEQ ID NO: 847)

F3:
RSDKLVR (SEQ ID NO: 848)

F4:
RSDELVR (SEQ ID NO: 849)

F5:
TSHSLTE (SEQ ID NO: 850)

F6:
RADNLTE; (SEQ ID NO: 851)

23)
F1:
ERSHLRE (SEQ ID NO: 852)

F2:
TSHSLTE (SEQ ID NO: 853)

F3:
QAGHLAS (SEQ ID NO: 854)

F4:
TSHSLTE (SEQ ID NO: 855)

F5:
DPGHLVR (SEQ ID NO: 856)

F6:
TSGNLVR; (SEQ ID NO: 857)

24)
F1:
RADNLTE (SEQ ID NO: 858)

F2:
TSGSLVR (SEQ ID NO: 859)

F3:
RKDNLKN (SEQ ID NO: 860)

F4:
QSSSLVR (SEQ ID NO: 861)

F5:
RSDKLVR (SEQ ID NO: 862)

F6:
DSGNLRV; (SEQ ID NO: 863)

25)
F1:
QSSSLVR (SEQ ID NO: 864)

F2:
QSGDLRR (SEQ ID NO: 865)

F3:
RSDERKR (SEQ ID NO: 866)

F4:
HRTTLTN (SEQ ID NO: 867)

F5:
RSDHLTN (SEQ ID NO: 868)

F6:
TSGELVR; (SEQ ID NO: 869)

26)
F1:
QSGDLRR (SEQ ID NO: 870)

F2:
RSDERKR (SEQ ID NO: 871)

-continued

```
F3:
                                  (SEQ ID NO: 872)
HRTTLTN

F4:
                                  (SEQ ID NO: 873)
RSDHLTN

F5:
                                  (SEQ ID NO: 874)
TSGELVR

F6:
                                  (SEQ ID NO: 875)
RSDDLVR;

27)
F1:
                                  (SEQ ID NO: 876)
QRAHLER

F2:
                                  (SEQ ID NO: 877)
QLAHLRA

F3:
                                  (SEQ ID NO: 878)
DPGHLVR

F4:
                                  (SEQ ID NO: 879)
RRSACRR

F5:
                                  (SEQ ID NO: 880)
RSDHLTT

F6:
                                  (SEQ ID NO: 881)
QSSSLVR;
and

28)
F1:
                                  (SEQ ID NO: 882)
QSSNLVR

F2:
                                  (SEQ ID NO: 883)
RSDDLVR

F3:
                                  (SEQ ID NO: 884)
THLDLIR

F4:
                                  (SEQ ID NO: 885)
TSGNLTE

F5:
                                  (SEQ ID NO: 886)
RRSACRR

F6:
                                  (SEQ ID NO: 887)
RNDTLTE.
```

107. The epigenetic-modifying DNA-targeting system of any of embodiments 102-106, wherein the zinc finger protein comprises six zinc fingers denoted F1 through F6 in order from N-terminus to C-terminus, and wherein the amino acid sequence of each zinc finger recognition region is as follows:

```
F1:
                                  (SEQ ID NO: 822)
QSAHRKN

F2:
                                  (SEQ ID NO: 823)
TSSNRKT

F3:
                                  (SEQ ID NO: 824)
RSDNLSA

F4:
                                  (SEQ ID NO: 825)
RNNDRKT

F5:
                                  (SEQ ID NO: 826)
TSGSLSR

F6:
                                  (SEQ ID NO: 827)
QAGHLAK.
```

108. The epigenetic-modifying DNA-targeting system of any of embodiments 102-106, wherein the zinc finger protein comprises six zinc fingers denoted F1 through F6 in order from N-terminus to C-terminus, and wherein the amino acid sequence of each zinc finger recognition region is as follows:

```
F1:
                                  (SEQ ID NO: 828)
RSDHLSQ

F2:
                                  (SEQ ID NO: 829)
ASSTRTK

F3:
                                  (SEQ ID NO: 830)
RSDDLTR

F4:
                                  (SEQ ID NO: 831)
QKSNLSS

F5:
                                  (SEQ ID NO: 832)
QSANRTT

F6:
                                  (SEQ ID NO: 833)
QNATRTK
```

109. The epigenetic-modifying DNA-targeting system of any of embodiments 102-106, wherein the zinc finger protein comprises six zinc fingers denoted F1 through F6 in order from N-terminus to C-terminus, and wherein the amino acid sequence of each zinc finger recognition region is as follows:

```
F1:
                                  (SEQ ID NO: 864)
QSSSLVR

F2:
                                  (SEQ ID NO: 865)
QSGDLRR

F3:
                                  (SEQ ID NO: 866)
RSDERKR

F4:
                                  (SEQ ID NO: 867)
HRTTLTN
```

-continued

F5:
RSDHLTN (SEQ ID NO: 868)

F6:
TSGELVR. (SEQ ID NO: 869)

110. An epigenetic-modifying DNA-targeting system comprising: a) an eZFP that binds to a target site in one or more HBV genes or regulatory elements thereof and b) at least one effector domain that represses transcription of one or more HBV genes, wherein the zinc finger protein comprises six zinc fingers denoted F1 through F6 in order from N-terminus to C-terminus, and wherein the amino acid sequence of each zinc finger recognition region is as follows:

1)
F1:
SEADRSR (SEQ ID NO: 720)

F2:
DRSNLTR (SEQ ID NO: 721)

F3:
QSSDLSR (SEQ ID NO: 722)

F4:
YHWYLKK (SEQ ID NO: 723)

F5:
RSDSLSV (SEQ ID NO: 724)

F6:
QNANRKT; (SEQ ID NO: 725)

2)
F1:
RSDVLST (SEQ ID NO: 726)

F2:
DNSSRTR (SEQ ID NO: 727)

F3:
RPYTLRL (SEQ ID NO: 728)

F4:
DSSHRTR (SEQ ID NO: 729)

F5:
RSDHLSQ (SEQ ID NO: 730)

F6:
DSSHRTR; (SEQ ID NO: 731)

3)
F1:
RSDHLSQ (SEQ ID NO: 732)

F2:
QSADRTK (SEQ ID NO: 733)

F3:
RSDHLSQ (SEQ ID NO: 734)

F4:
RRSDLKR (SEQ ID NO: 735)

F5:
RSDHLSR (SEQ ID NO: 736)

F6:
QSSDLRR; (SEQ ID NO: 737)

4)
F1:
RSDNLSE (SEQ ID NO: 738)

F2:
TSSNRKT (SEQ ID NO: 739)

F3:
DRSHLTR (SEQ ID NO: 740)

F4:
RSDALTQ (SEQ ID NO: 741)

F5:
DRSALAR (SEQ ID NO: 742)

F6:
RRFTLSK; (SEQ ID NO: 743)

5)
F1:
RSDHLSE (SEQ ID NO: 744)

F2:
QYSGRYY (SEQ ID NO: 745)

F3:
HGQTLNE (SEQ ID NO: 746)

F4:
QSGNLAR (SEQ ID NO: 747)

F5:
RSDSLLR (SEQ ID NO: 748)

F6:
CREYRGK; (SEQ ID NO: 749)

6)
F1:
QSANRTT (SEQ ID NO: 750)

F2:
RSANLTR (SEQ ID NO: 751)

F3:
RSDVLSE (SEQ ID NO: 752)

-continued

F4:
TSGHLSR (SEQ ID NO: 753)

F5:
QSSDLSR, (SEQ ID NO: 754)

F6:
QWSTRKR; (SEQ ID NO: 755)

7)
F1:
QSGNLAR (SEQ ID NO: 756)

F2:
ATCCLAH (SEQ ID NO: 757)

F3:
RWQYLPT (SEQ ID NO: 758)

F4:
DRSALAR (SEQ ID NO: 759)

F5:
RSDNLSE (SEQ ID NO: 760)

F6:
KRCNLRC; (SEQ ID NO: 761)

8)
F1:
NPANLTR (SEQ ID NO: 762)

F2:
QNATRTK (SEQ ID NO: 763)

F3:
QSGHLAR (SEQ ID NO: 764)

F4:
NRHDRAK (SEQ ID NO: 765)

F5:
RSDHLSE, (SEQ ID NO: 766)

F6:
QRRSRYK; (SEQ ID NO: 767)

9)
F1:
QSSDLSR (SEQ ID NO: 768)

F2:
HRSTRNR (SEQ ID NO: 769)

F3:
RSDVLSA (SEQ ID NO: 770)

F4:
DSRTRKN (SEQ ID NO: 771)

-continued

F5:
QSGSLTR (SEQ ID NO: 772)

F6:
DQSGLAH; (SEQ ID NO: 773)

10)
F1:
QNPAQWR (SEQ ID NO: 774)

F2:
RSADLSR (SEQ ID NO: 775)

F3:
TSGSLSR (SEQ ID NO: 776)

F4:
RSDHLSR (SEQ ID NO: 777)

F5:
RSDSLLR (SEQ ID NO: 778)

F6:
QSYDRFQ; (SEQ ID NO: 779)

11)
F1:
TSGSLSR (SEQ ID NO: 780)

F2:
RSDHLSR (SEQ ID NO: 781)

F3:
RSDSLLR (SEQ ID NO: 782)

F4:
QSYDRFQ (SEQ ID NO: 783)

F5:
RSDNLST (SEQ ID NO: 784)

F6:
DNRDRIK; (SEQ ID NO: 785)

12)
F1:
DRSNLSR (SEQ ID NO: 786)

F2:
LRQNLIM (SEQ ID NO: 787)

F3:
ERGTLAR (SEQ ID NO: 788)

F4:
RSDALTQ (SEQ ID NO: 789)

F5:
RSDSLSQ (SEQ ID NO: 790)

-continued

12)
F6:
RKADRTR; (SEQ ID NO: 791)

13)
F1:
QYCCLTN (SEQ ID NO: 792)

F2:
TSGNLTR (SEQ ID NO: 793)

F3:
QSSDLSR (SEQ ID NO: 794)

F4:
FRYYLKR (SEQ ID NO: 795)

F5:
QSGDLTR (SEQ ID NO: 796)

F6:
DKGNLTK; (SEQ ID NO: 797)

14)
F1:
TSGSLSR (SEQ ID NO: 798)

F2:
RSDNLTT (SEQ ID NO: 799)

F3:
QSGNLAR (SEQ ID NO: 800)

F4:
DRTTLMR (SEQ ID NO: 801)

F5:
QSGHLAR (SEQ ID NO: 802)

F6:
QLTHLNS; (SEQ ID NO: 803)

15)
F1:
IKHDLHR (SEQ ID NO: 804)

F2:
RSANLTR (SEQ ID NO: 805)

F3:
RSDNLAR (SEQ ID NO: 806)

F4:
QNVSRPR (SEQ ID NO: 807)

F5:
RSDDLSK (SEQ ID NO: 808)

F6:
DSSHRTR; (SEQ ID NO: 809)

-continued

16)
F1:
RSDNLAR (SEQ ID NO: 810)

F2:
QNVSRPR (SEQ ID NO: 811)

F3:
RSDDLSK (SEQ ID NO: 812)

F4:
DSSHRTR (SEQ ID NO: 813)

F5:
TSSNRKT (SEQ ID NO: 814)

F6:
AQWTRAC; (SEQ ID NO: 815)

17)
F1:
RSDDLSK (SEQ ID NO: 816)

F2:
DSSHRTR (SEQ ID NO: 817)

F3:
TSSNRKT (SEQ ID NO: 818)

F4:
AQWTRAC (SEQ ID NO: 819)

F5:
RKQTRTT (SEQ ID NO: 820)

F6:
HRSSLRR; (SEQ ID NO: 821)

18)
F1:
QSAHRKN (SEQ ID NO: 822)

F2:
TSSNRKT (SEQ ID NO: 823)

F3:
RSDNLSA (SEQ ID NO: 824)

F4:
RNNDRKT (SEQ ID NO: 825)

F5:
TSGSLSR (SEQ ID NO: 826)

F6:
QAGHLAK; (SEQ ID NO: 827)

19)
F1:
RSDHLSQ (SEQ ID NO: 828)

F2:
        (SEQ ID NO: 829)
ASSTRTK

F3:
        (SEQ ID NO: 830)
RSDDLTR

F4:
        (SEQ ID NO: 831)
QKSNLSS

F5:
        (SEQ ID NO: 832)
QSANRTT

F6:
        (SEQ ID NO: 833)
QNATRTK;

20)
F1:
        (SEQ ID NO: 834)
RSDTLSE

F2:
        (SEQ ID NO: 835)
RRWTLVG

F3:
        (SEQ ID NO: 836)
DRSNLSR

F4:
        (SEQ ID NO: 837)
QSGDLTR

F5:
        (SEQ ID NO: 838)
QSSDLSR

F6:
        (SEQ ID NO: 839)
YHWYLKK;

21)
F1:
        (SEQ ID NO: 840)
RSANLAR

F2:
        (SEQ ID NO: 841)
RSDNLRE

F3:
        (SEQ ID NO: 842)
RPYTLRL

F4:
        (SEQ ID NO: 843)
HRSNLNK

F5:
        (SEQ ID NO: 844)
QSGSLTR

F6:
        (SEQ ID NO: 845)
TSANLSR;

22)
F1:
        (SEQ ID NO: 846)
RSDDLVR

F2:
        (SEQ ID NO: 847)
TSGSLVR

F3:
        (SEQ ID NO: 848)
RSDKLVR

F4:
        (SEQ ID NO: 849)
RSDELVR

F5:
        (SEQ ID NO: 850)
TSHSLTE

F6:
        (SEQ ID NO: 851)
RADNLTE;

23)
F1:
        (SEQ ID NO: 852)
ERSHLRE

F2:
        (SEQ ID NO: 853)
TSHSLTE

F3:
        (SEQ ID NO: 854)
QAGHLAS

F4:
        (SEQ ID NO: 855)
TSHSLTE

F5:
        (SEQ ID NO: 856)
DPGHLVR

F6:
        (SEQ ID NO: 857)
TSGNLVR;

24)
F1:
        (SEQ ID NO: 858)
RADNLTE

F2:
        (SEQ ID NO: 859)
TSGSLVR

F3:
        (SEQ ID NO: 860)
RKDNLKN

F4:
        (SEQ ID NO: 861)
QSSSLVR

F5:
        (SEQ ID NO: 862)
RSDKLVR

F6:
        (SEQ ID NO: 863)
DSGNLRV;

25)
F1:
        (SEQ ID NO: 864)
QSSSLVR

F2:
        (SEQ ID NO: 865)
QSGDLRR

F3:
        (SEQ ID NO: 866)
RSDERKR

F4:
HRTTLTN (SEQ ID NO: 867)

F5:
RSDHLTN (SEQ ID NO: 868)

F6:
TSGELVR; (SEQ ID NO: 869)

26)
F1:
QSGDLRR (SEQ ID NO: 870)

F2:
RSDERKR (SEQ ID NO: 871)

F3:
HRTTLTN (SEQ ID NO: 872)

F4:
RSDHLTN (SEQ ID NO: 873)

F5:
TSGELVR (SEQ ID NO: 874)

F6:
RSDDLVR; (SEQ ID NO: 875)

27)
F1:
QRAHLER (SEQ ID NO: 876)

F2:
QLAHLRA (SEQ ID NO: 877)

F3:
DPGHLVR (SEQ ID NO: 878)

F4:
RRSACRR (SEQ ID NO: 879)

F5:
RSDHLTT (SEQ ID NO: 880)

F6:
QSSSLVR; and (SEQ ID NO: 881)

28)
F1:
QSSNLVR (SEQ ID NO: 882)

F2:
RSDDLVR (SEQ ID NO: 883)

F3:
THLDLIR (SEQ ID NO: 884)

F4:
TSGNLTE (SEQ ID NO: 885)

F5:
RRSACRR (SEQ ID NO: 886)

F6:
RNDTLTE. (SEQ ID NO: 887)

111. The epigenetic-modifying DNA-targeting system of any of embodiments 102-110, wherein the engineered zinc finger protein comprises the sequence set forth in any one of SEQ ID NOS: 692-719, or a portion thereof, or an amino acid sequence that has at least 90%, 91%, 92%, 93%, 94%, 95%, 96%, 97%, 98%, or 99% sequence identity thereto.

112. The epigenetic-modifying DNA-targeting system of any of embodiments 102-111, wherein the engineered zinc finger protein is encoded by the sequence set forth in any one of SEQ ID NOS:888-915, or a portion thereof, or nucleotide sequence that has at least 90%, 91%, 92%, 93%, 94%, 95%, 96%, 97%, 98%, or 99% sequence identity thereto.

113. An epigenetic-modifying DNA-targeting system comprising: a) an engineered zinc finger protein that binds to a target site in one or more HBV genes or regulatory elements thereof, and b) at least one effector domain that represses transcription of one or more HBV genes, wherein the zinc finger protein comprises six zinc fingers denoted F1 through F6 in order from N-terminus to C-terminus, and wherein the amino acid sequence of each zinc finger recognition region is as follows:

F1:
QSAHRKN (SEQ ID NO: 822)

F2:
TSSNRKT (SEQ ID NO: 823)

F3:
RSDNLSA (SEQ ID NO: 824)

F4:
RNNDRKT (SEQ ID NO: 825)

F5:
TSGSLSR (SEQ ID NO: 826)

F6:
QAGHLAK. (SEQ ID NO: 827)

114. The epigenetic-modifying DNA-targeting system of any of embodiments 102-113, wherein the eZFP comprises the sequence set forth in SEQ ID NO: 709, or a portion thereof, or an amino acid sequence that has at least 90%, 91%, 92%, 93%, 94%, 95%, 96%, 97%, 98%, or 99% sequence identity thereto.

115. The epigenetic-modifying DNA-targeting system of any of embodiments 102-114, wherein the engineered zinc finger protein comprises the sequence set forth in any one of SEQ ID NOS: 709.

116. The epigenetic-modifying DNA-targeting system of any of embodiment 102-115, wherein the engineered zinc finger protein is encoded by the sequence set forth in SEQ ID NO:905, or a portion thereof, or nucleotide sequence that has at least 90%, 91%, 92%, 93%, 94%, 95%, 96%, 97%, 98%, or 99% sequence identity thereto.

117. The epigenetic-modifying DNA-targeting system of any of embodiments 102-116, wherein the engineered zinc finger protein is encoded by the sequence set forth in any one of SEQ ID NOS:905.

118. An epigenetic-modifying DNA-targeting system comprising: a) an engineered zinc finger protein that binds to a target site in one or more HBV genes or regulatory elements thereof, and b) at least one effector domain that represses transcription of one or more HBV genes,
wherein the zinc finger protein comprises six zinc fingers denoted F1 through F6 in order from N-terminus to C-terminus, and wherein the amino acid sequence of each zinc finger recognition region is as follows:

F1:
(SEQ ID NO: 828)
RSDHLSQ

F2:
(SEQ ID NO: 829)
ASSTRTK

F3:
(SEQ ID NO: 830)
RSDDLTR

F4:
(SEQ ID NO: 831)
QKSNLSS

F5:
(SEQ ID NO: 832)
QSANRTT

F6:
(SEQ ID NO: 833)
QNATRTK.

119. The epigenetic-modifying DNA-targeting system of any of embodiments 102-112 and 118, wherein the engineered zinc finger protein comprises the sequence set forth in SEQ ID NO: 710, or a portion thereof, or an amino acid sequence that has at least 90%, 91%, 92%, 93%, 94%, 95%, 96%, 97%, 98%, or 99% sequence identity thereto.

120. The epigenetic-modifying DNA-targeting system of any of embodiments 102-112, 118 or 119, wherein the engineered zinc finger protein comprises the sequence set forth in any one of SEQ ID NOS: 710.

121. The epigenetic-modifying DNA-targeting system of embodiments 102-112 and 118-120, wherein the engineered zinc finger protein is encoded by the sequence set forth in SEQ ID NO:906, or a portion thereof, or nucleotide sequence that has at least 90%, 91%, 92%, 93%, 94%, 95%, 96%, 97%, 98%, or 99% sequence identity thereto.

122. The epigenetic-modifying DNA-targeting system of any of embodiments 102-112 and 118-121, wherein the engineered zinc finger protein is encoded by the sequence set forth in any one of SEQ ID NOS: 906.

123. An epigenetic-modifying DNA-targeting system comprising: a) an engineered zinc finger protein that binds to a target site in one or more HBV genes or regulatory elements thereof, and b) at least one effector domain that represses transcription of one or more HBV genes,
wherein the zinc finger protein comprises six zinc fingers denoted F1 through F6 in order from N-terminus to C-terminus,
and wherein the amino acid sequence of each zinc finger recognition region is as follows:

F1:
(SEQ ID NO: 864)
QSSSLVR

F2:
(SEQ ID NO: 865)
QSGDLRR

F3:
(SEQ ID NO: 866)
RSDERKR

F4:
(SEQ ID NO: 867)
HRTTLTN

F5:
(SEQ ID NO: 868)
RSDHLTN

F6:
(SEQ ID NO: 869)
TSGELVR.

124. The epigenetic-modifying DNA-targeting system of any of embodiments 102-112 and 123, wherein the engineered zinc finger protein comprises the sequence set forth in SEQ ID NO: 716, or a portion thereof, or an amino acid sequence that has at least 90%, 91%, 92%, 93%, 94%, 95%, 96%, 97%, 98%, or 99% sequence identity thereto.

125. The epigenetic-modifying DNA-targeting system of any of embodiments 102-112, 123 or 124, wherein the engineered zinc finger protein comprises the sequence set forth in any one of SEQ ID NOS: 716.

126. The epigenetic-modifying DNA-targeting system of any of embodiments 102-112 and 123-125, wherein the engineered zinc finger protein is encoded by the sequence set forth in SEQ ID NO:912, or a portion thereof, or nucleotide sequence that has at least 90%, 91%, 92%, 93%, 94%, 95%, 96%, 97%, 98%, or 99% sequence identity thereto.

127. The epigenetic-modifying DNA-targeting system of any of embodiments 102-112 and 123-126, wherein the engineered zinc finger protein is encoded by the sequence set forth in any one of SEQ ID NOS:912.

128. The epigenetic-modifying DNA-targeting system of any of embodiments 1-127, wherein the at least one effector domain induces transcription repression.

129. The epigenetic-modifying DNA-targeting system of any of embodiment 1-128, wherein the at least one effector domain is a DNA methyltransferase.

130. The epigenetic modifying DNA-targeting system of any of embodiments 1-129, wherein the at least one effector domain comprises a DNA methyltransferase and a repressor domain capable of recruiting heterochromatin inducing factors or optionally wherein the heterochromatin inducing factors include a histone methyltransferase.

131. The epigenetic modifying DNA-targeting system of any of embodiments 1-130, wherein the at least one effector domain comprises a DNA methyltransferase and a histone methyltransferase.

132. The epigenetic-modifying DNA-targeting system of any of embodiments 1-131, wherein at least one effector domain is selected from a KRAB repressor domain, ERF repressor domain, Mxil repressor domain, SID4X repressor domain, Mad-SID repressor domain, LSD1 repressor domain, or DNMT3A, DNMT3A-3L, DNMT3A/L-KRAB fusion repressor domain, DNMT3B domain binding protein, EZH2 repressor domain, or LSD1 repressor domain, or variant of any of the foregoing.

133. The epigenetic-modifying DNA-targeting system of any of embodiments 1-132, wherein the at least one effector domain comprises a sequence selected from any one of SEQ ID NOS: 590, or 600-608, 651, 661, 664, 665, 666, 668 and 669 or a domain thereof, a portion thereof, or an amino acid sequence that has at least 90%, 91%, 92%, 93%, 94%, 95%, 96%, 97%, 98%, or 99% sequence identity to any of the foregoing.

134. The epigenetic-modifying DNA-targeting system of any of embodiments 1-133, wherein the at least one effector domain comprises a KRAB domain or a variant thereof.

135. The epigenetic-modifying DNA-targeting system of any of embodiments 1-134 wherein the at least one effector domain comprises the sequence set forth in SEQ ID NO: 590 a portion thereof, or an amino acid sequence that has at least 90%, 91%, 92%, 93%, 94%, 95%, 96%, 97%, 98%, or 99% sequence identity to any of the foregoing.

136. The epigenetic-modifying DNA-targeting system of any of embodiments 1-134, wherein the at least one effector domain comprises a DNMT3A/L domain or a variant thereof.

137. The epigenetic-modifying DNA-targeting system of any of embodiments 1-136, wherein:
the at least one effector domain comprises the sequence set forth in SEQ ID NOS: 604 and 607, a portion thereof, or an amino acid sequence that has at least 90%, 91%, 92%, 93%, 94%, 95%, 96%, 97%, 98%, or 99% sequence identity to any of the foregoing; or
the at least one effector domain comprises the sequence set forth in SEQ ID NO: 651, a portion thereof, or an amino acid sequence that has at least 90%, 91%, 92%, 93%, 94%, 95%, 96%, 97%, 98%, or 99% sequence identity to SEQ ID NO:651.

138. The epigenetic-modifying DNA-targeting system of any of embodiments 1-137, wherein the fusion protein comprises a DNMT3A/3L-dCas9-KRAB fusion protein.

139. The epigenetic-modifying DNA-targeting system of any of embodiments 1-138, wherein the fusion protein comprises the sequence set forth in SEQ ID NO: 645 a portion thereof, or an amino acid sequence that has at least 90%, 91%, 92%, 93%, 94%, 95%, 96%, 97%, 98%, or 99% sequence identity to any of the foregoing.

140. The epigenetic-modifying DNA-targeting system of any of embodiments 1-139, wherein the at least one effector domain is fused to the N-terminus, the C-terminus, or both the N-terminus and the C-terminus, of the DNA-binding domain or a component thereof.

141. The epigenetic-modifying DNA-targeting system of any of embodiments 1-101, or 138-140, wherein the fusion protein is encoded by the sequence set forth in SEQ ID NO: 680, a portion thereof, or an amino acid sequence that has at least 90%, 91%, 92%, 93%, 94%, 95%, 96%, 97%, 98%, or 99% sequence identity to any of the foregoing.

142. The epigenetic-modifying DNA-targeting system of any of embodiments 1-101, or 138-140, wherein the fusion protein is encoded by the sequence set forth in SEQ ID NO: 680.

143. The epigenetic-modifying DNA-targeting system of any of embodiments 1-5, 11-18, 20-33, 34-61, and 102-140, wherein the fusion protein is encoded by the sequence set forth in any one of SEQ ID NOS:916-943, a portion thereof, or a nucleic acid sequence that has at least 90%, 91%, 92%, 93%, 94%, 95%, 96%, 97%, 98%, or 99% sequence identity to any of the foregoing.

144. The epigenetic-modifying DNA-targeting system of embodiment 1-5, 11-18, 20-33, 34-61, 102-140, and 143, wherein the fusion protein comprises the sequence set forth in any one of SEQ ID NOS:944-971, a portion thereof, or an amino acid sequence that has at least 90%, 91%, 92%, 93%, 94%, 95%, 96%, 97%, 98%, or 99% sequence identity to any of the foregoing.

145. The epigenetic-modifying DNA-targeting system of any of embodiments 1-5, 11-18, 20-33, 34-61, 102-140, and 143-144, wherein the fusion protein comprises the sequence set forth in any one of SEQ ID NOS: 961, 962, or 968.

146. The epigenetic-modifying DNA-targeting system of any of embodiments 1-5, 11-18, 20-33, 34-61, 102-140, and 143-145, wherein the fusion protein comprises a DNMT3A/3L-eZFP-KRAB fusion protein.

147. The epigenetic-modifying DNA-targeting system of any of embodiments 1-4, 11-18, 20-33, 34-61, 102-140, and 143-146, wherein the fusion protein is encoded by the sequence set forth in any one of SEQ ID NOS:972-999, a portion thereof, or a nucleic acid sequence that has at least 90%, 91%, 92%, 93%, 94%, 95%, 96%, 97%, 98%, or 99% sequence identity to any of the foregoing.

148. The epigenetic-modifying DNA-targeting system of any of embodiments 1-5, 11-18, 20-33, 34-61, 102-140, and 143-147, wherein the fusion protein is encoded by the sequence set forth in any one of SEQ ID NOS:933, 934, or 940, a portion thereof, or a nucleic acid sequence that has at least 90%, 91%, 92%, 93%, 94%, 95%, 96%, 97%, 98%, or 99% sequence identity to any of the foregoing.

149. The epigenetic-modifying DNA-targeting system of any of embodiments 1-5, 11-18, 20-33, 34-61, 102-140, and 143-148, wherein the fusion protein comprises the sequence set forth in any one of SEQ ID NOS:1000-1027, a portion thereof, or an amino acid sequence that has at least 90%, 91%, 92%, 93%, 94%, 95%, 96%, 97%, 98%, or 99% sequence identity to any of the foregoing.

150. The epigenetic-modifying DNA-targeting system of any of embodiments 1-4, 11-18, 20-33, 34-61, 102-140, and 143-149, wherein the fusion protein comprises the sequence set forth in any one of SEQ ID NOS:1017, 1018, or 1024, a portion thereof, or an amino acid sequence that has at least 90%, 91%, 92%, 93%, 94%, 95%, 96%, 97%, 98%, or 99% sequence identity to any of the foregoing.

151. The epigenetic-modifying DNA-targeting system of any of embodiments 1-150, wherein the fusion protein further comprises one or more nuclear localization signals (NLS).

152. The epigenetic-modifying DNA-targeting system of any of embodiments 1-151, wherein the fusion protein further comprises one or more linkers connecting two or more of: the DNA-binding domain, the at least one effector domain, and the one or more nuclear localization signals.

153. The epigenetic-modifying DNA-targeting system of any of embodiments 1-152, wherein the DNA-targeting system targets all Hepatitis B viral genomes.

154. The epigenetic-modifying DNA-targeting system of any of embodiments 1-153, wherein the DNA-targeting system targets at least 70% of all Hepatitis B viral genomes.

155. The epigenetic-modifying DNA-targeting system of any of embodiments 1-154, wherein the DNA-targeting system targets at least 60% of all Hepatitis B viral genomes.

156. The epigenetic-modifying DNA-targeting system of any of embodiments 1-155, wherein the DNA-targeting system targets at least 50% of all Hepatitis B viral genomes.

157. The epigenetic-modifying DNA-targeting system of any one of embodiments 1-156, wherein the DNA-targeting system is not able to introduce a genetic disruption or a DNA break at or near the target site 158. The epigenetic-modifying DNA-targeting system of any of embodiments 1-157, wherein repressing transcription of one or more HBV genes results in a reduction in RNA levels and/or protein levels from the HBV DNA sequence.

159. The epigenetic-modifying DNA-targeting system of any of embodiments 1-158, wherein repressing transcription comprises a reduction in total Hepatitis B viral RNA transcript levels.

160. The epigenetic-modifying DNA-targeting system of any of embodiments 1-159, wherein repressing transcription comprises a reduction in Hepatitis B pre-core ("preC"), pre-genomic ("pgRNA"), preS1, preS2/S, and HBx levels.

161. The epigenetic-modifying DNA-targeting system of any of embodiments 1-160, wherein repressing transcription comprises a reduction in HBx levels.

162. The epigenetic-modifying DNA-targeting system of any of embodiments 1-161, wherein repressing transcription comprises a reduction in Hepatitis B surface antigen (HBsAg) and/or Hepatitis B viral core-related-antigen (HbcrAg) protein levels.

163. The epigenetic-modifying DNA-targeting system of any of embodiments 1-162, wherein repressing transcription comprises a reduction in HbsAg transcript and/or protein levels by at least 90%.

164. The epigenetic-modifying DNA-targeting system of any of embodiments 1-163, wherein repressing transcription comprises a reduction in HbcrAg transcript and/or protein levels by at least 50% from the cccDNA.

165. A guide RNA (gRNA) that binds a target site in a Hepatitis B viral DNA sequence.

166. The gRNA of embodiment 165, wherein the Hepatitis B viral DNA sequence is Hepatitis B (HBV) gene or regulatory element thereof.

167. The gRNA of embodiment 165 or embodiment 166, wherein the target site is present in a covalently closed circular DNA (cccDNA) form, relaxed circular DNA (rcDNA) form and/or is integrated in the human genomic DNA.

168. The gRNA of any of embodiments 165-167, wherein the target site is at or near a gene or a regulatory element thereof involved in controlling HBV replication and/or HBV transcription.

169. The gRNA of embodiment 168, wherein the gene involved in controlling HBV replication and/or HBV transcription encodes a polymerase, an envelope protein, capsid protein, transcription factor, or transcriptional transactivator.

170. The gRNA of embodiment 168 or embodiment 169, wherein the gene involved in controlling HBV replication and/or HBV transcription is a polymerase gene, S-family gene, X-gene, or core-family gene.

171. The gRNA of any of embodiments 165-170, wherein the target site is in a gene or regulatory element thereof of the X-gene encoding Hepatitis B Virus Protein X (HBx).

172. The gRNA of any of embodiments 165-171, wherein the target site is at or near a regulatory element involved in controlling HBV replication and/or HBV transcription.

173. The gRNA of embodiment 166-172, wherein the regulatory element is a promoter region.

174. The gRNA of embodiment 173, wherein the promoter region is a pre-S1 promoter, a pre-S2 promoter, X promoter, or basal core promoter.

175. The gRNA of any of embodiments 166-172, wherein the regulatory element is an enhancer region.

176 The gRNA of embodiment 175, wherein the enhancer region is an Enh1 or an Enh2 enhancer region.

177. The gRNA of any of embodiments 166-172, wherein the regulatory element is a transcript processing control region.

178. The gRNA of any of embodiments 165-171, wherein the target site is a coding region.

179. The gRNA of any of embodiments 165-178, wherein the target site is located within 500 bp, within 1000 bp, within 1500 bp of a transcription start site.

180. The gRNA of any of embodiments 165-179, wherein the target site is positioned within a target region that has a sequence corresponding to the sequence located at base pairs between 0-3300 base pairs (bp) of the HBV genome, optionally between 0-3189 bp of the HBV genome, with reference to the HBV genome set forth in SEQ ID NO: 650.

181. The gRNA of any of embodiments 165-180, wherein the target site is positioned within a target region that has a sequence corresponding to the sequence located at base pairs between 43 bp-490 bp, 1033 bp-1749 bp, 1800 bp-1950 bp, or 2953 bp-3182 bp of the HBV genome with reference to the HBV genome set forth in SEQ ID NO: 650.

182. The gRNA of any of embodiments 165-181, wherein the target site is positioned within a target region that has a sequence corresponding to the sequence located at base pairs between 1 bp-42 bp, 491 bp-1032 bp, 1750 bp-1799 bp, or 1951 bp-2952 bp of the HBV genome with reference to the HBV genome set forth in SEQ ID NO: 650.

183. The gRNA of any of embodiments 165-182, wherein the target site is in a CpG island of the HBV genome.

184. The gRNA of any of embodiments 165-183, wherein the target site is positioned within a target region that has a sequence corresponding to the sequence located at base pairs between 67 bp-392 bp, 1033 bp-1749 bp, or 2215 bp-2490 bp of the HBV genome with reference to the HBV genome set forth in SEQ ID NO: 650.

185. The gRNA of any of embodiments 165-184, wherein the target site is positioned within a target region that has a sequence corresponding to the sequence located at base pairs between 1033 bp-1749 bp of the HBV genome with reference to the HBV genome set forth in SEQ ID NO: 650.

186. The gRNA of any of embodiments 165-185, wherein the target site is within a target region spanning within 300 base pairs upstream of the hepatitis B X protein (HBx) start codon.

187. A gRNA (gRNA) that binds a target site within a target region spanning within 300 base pairs upstream of the hepatitis B X protein (HBx) start codon.

188. The gRNA of any of embodiments 165-187, wherein the target site is positioned in the HBx basal core promoter region.

189. The gRNA of any of embodiments 165-187, wherein the target site is positioned within the HBx promoter/Enhancer region.

190. The gRNA of any of embodiments 165-189, wherein the target site is within a target region spanning within 250 base pairs upstream of the hepatitis B X protein (HBx) start codon.

191. The gRNA of any of embodiments 165-190, wherein the target site is within a target region that has a sequence corresponding to the sequence located at base pairs between 1060-1480 bp of the HBV genome with reference to the HBV genome set forth in SEQ ID NO: 650.

192. The gRNA of any of embodiments 165-191, wherein the target site is within a target region spanning within 150 base pairs upstream of the hepatitis B X protein (HBx) start codon.

193. The gRNA of any of embodiments 165-192, wherein the target site is within a target region spanning within 120 base pairs upstream of the hepatitis B X protein (HBx) start codon.

194. The gRNA of any of embodiments 165-193, wherein the target site is within a target region that has a sequence corresponding to the sequence located at base pairs between 1250-1374 bp of the HBV genome with reference to the HBV genome set forth in SEQ ID NO: 650.

195. The gRNA of any of embodiments 165-194, wherein the target site is within a target region that has a sequence corresponding to the sequence located at base pairs between 1255-1302 bp of the HBV genome with reference to the HBV genome set forth in SEQ ID NO: 650.

196. The gRNA of any of embodiments 165-195, wherein the target site is within a target region that has a sequence corresponding to the sequence located at base pairs between 1260-1300 bp of the HBV genome with reference to the HBV genome set forth in SEQ ID NO: 650.

197. The gRNA of any of embodiments 165-196, wherein the gRNA comprises the sequence set forth in any one of SEQ ID NOS: 200, 201, 207, 217, 221, 224, 233, 237, 238, 246, 251, 256, 258, 263, 267, 274, 270, 277, 279, 283, 284, 293, 294, 308, 311, 313, 316, 319, 320, 325, 328, 330, 333, 338, 345, 347, 350, 353, 359, 360, 369, 370, 371, 377, 380, 384, 385, or 387, a contiguous portion thereof of at least 14 nucleotides, or a complementary sequence of any of the foregoing, optionally wherein the gRNA, or each of the gRNA, is set forth in any one of SEQ ID NOS: 395, 402, 408, 412, 416, 419, 428, 432, 433, 441, 446, 451, 453, 458, 462, 465, 469, 472, 474, 478, 479, 488, 489, 503, 506, 508, 511, 514, 515, 520, 523, 525, 575, 528, 533, 540, 542, 545, 548, 554, 555, 565, 566, 572, 579, 580, or 582.

198. The gRNA of any of any of embodiments 165-196, wherein the gRNA is set forth in any one of SEQ ID NOS: 395, 402, 408, 412, 416, 419, 428, 432, 433, 441, 446, 451, 453, 458, 462, 465, 469, 472, 474, 478, 479, 488, 489, 503, 506, 508, 511, 514, 515, 520, 523, 525, 575, 528, 533, 540, 542, 545, 548, 554, 555, 565, 566, 572, 579, 580, or 582.

199. The gRNA of any of embodiments 165-198, wherein the gRNA comprises the sequence set forth in any one of SEQ ID NOS: 207, 213, 215, 217, 221, 222, 241, 245, 258, 261, 268, 274, 380, 387, a contiguous portion thereof of at least 14 nucleotides, or a complementary sequence of any of the foregoing, optionally wherein the gRNA, or each of the gRNA, is set forth in any one of SEQ ID NOS: 402, 408, 410, 412, 416, 417, 436, 440, 453, 456, 463, 469, 575, or 582.

200. The gRNA of any of embodiments 165-199, wherein the gRNA comprises the sequence set forth in any one of SEQ ID NOS: 402, 408, 410, 412, 416, 417, 436, 440, 453, 456, 463, 469, 575, or 582.

201. The gRNA of any of embodiments 165-200, wherein the gRNA comprises the sequence set forth in SEQ ID NO: 217, a contiguous portion thereof of at least 14 nucleotides, or a complementary sequence of any of the foregoing, optionally wherein the gRNA, or each of the gRNA, is set forth in any one of SEQ ID NO: 412.

202. The gRNA of any of embodiments 165-201, wherein the gRNA comprises the sequence set forth in SEQ ID NO: 412.

203. A CRISPR Cas-guide RNA (gRNA) combination comprising:
   (a) a Clustered Regularly Interspaced Short Palindromic Repeats associated (Cas) protein or variant thereof; and
   (b) at least one gRNA of any of embodiments 165-202 that targets the Cas protein or variant thereof to a target site in target site in a Hepatitis B viral DNA sequence.

204. The CRISPR Cas-gRNA combination of embodiment 203, wherein the Cas protein or a variant thereof is a Cas9 protein or a variant thereof.

205. The CRISPR Cas-gRNA combination of embodiment 203 or embodiment 204, wherein the Cas protein or a variant thereof is a variant Cas protein, wherein the variant Cas protein lacks nuclease activity or is a deactivated Cas (dCas) protein.

206. The CRISPR Cas-gRNA combination of embodiment 203-205, wherein the variant Cas protein is a variant Cas9 protein that lacks nuclease activity or that is a deactivated Cas9 (dCas9) protein.

207. The CRISPR Cas-gRNA combination of any of embodiments 203-206, wherein the Cas9 protein or a variant thereof is a *Staphylococcus aureus* Cas9 (SaCas9) protein or a variant thereof.

208. The CRISPR Cas-gRNA combination of embodiment 207, wherein the variant Cas9 is a *Staphylococcus aureus* dCas9 protein (dSaCas9) that comprises at least one amino acid mutation selected from D10A and N580A, with reference to numbering of positions of SEQ ID NO: 596.

209. The CRISPR Cas-gRNA combination of embodiment 207 or embodiment 208, wherein the variant Cas9 protein comprises the sequence set forth in SEQ ID NO: 597, or an amino acid sequence that has at least 90%, 91%, 92%, 93%, 94%, 95%, 96%, 97%, 98%, or 99% sequence identity thereto.

210. The CRISPR Cas-gRNA combination of any of embodiments 203-206, wherein the Cas9 protein or variant thereof is a *Streptococcus pyogenes* Cas9 (SpCas9) protein or a variant thereof.
211. The CRISPR Cas-gRNA combination of embodiment 210, wherein the variant Cas9 is a *Streptococcus pyogenes* dCas9 (dSpCas9) protein that comprises at least one amino acid mutation selected from D10A and H840A, with reference to numbering of positions of SEQ ID NO: 598.
212. The CRISPR Cas-gRNA combination of embodiment 210 or embodiment 211, wherein the variant Cas9 protein comprises the sequence set forth in SEQ ID NO: 599, or an amino acid sequence that has at least 90%, 91%, 92%, 93%, 94%, 95%, 96%, 97%, 98%, or 99% sequence identity thereto.
213. A polynucleotide encoding the epigenetic-modifying DNA-targeting system of any of embodiments 1-164 or a fusion protein of the DNA-targeting system of any of embodiments 1-164, the gRNA of any of embodiments 165-202, the CRISPR Cas-gRNA combination of any of embodiments 203-212, or a portion or a component of any of the foregoing.
214. A plurality of polynucleotides encoding the epigenetic-modifying DNA-targeting system of any of embodiments 1-164 or the fusion protein of the DNA-targeting system of any of embodiments 1-164, the gRNA of any of embodiments 165-202, the CRISPR Cas-gRNA combination of any of embodiments 203-212, or a portion or a component of any of the foregoing.
215. A vector comprising the polynucleotide of embodiment 213.
216. A vector comprising the plurality of polynucleotides of embodiment 214.
217. The vector of any of embodiments 215 or 216, wherein the vector is a viral vector.
218. The vector of embodiment 217, wherein the vector is an adeno-associated virus (AAV) vector.
219. The vector of embodiment 218, wherein the vector is selected from among AAV1, AAV2, AAV3, AAV4, AAV5, AAV6, AAV7, AAV8, or AAV9.
220. The vector of embodiment 219, wherein the vector is a lentiviral vector.
221. The vector of embodiment 215 or embodiment 216, wherein the vector is a non-viral vector.
222. The vector of embodiment 221, wherein the non-viral vector is selected from: a lipid nanoparticle, a liposome, an exosome, or a cell penetrating peptide.
223. The vector of any of embodiments 215-222, wherein the vector exhibits tropism towards a Hepatitis B virus infected cell, optionally wherein the infected cell is a hepatocyte.
224. The vector of any of embodiments 215-223, wherein the vector comprises one vector, or two or more vectors.
225. A method of promoting epigenetic modification within a target region in a Hepatitis B viral sequence, the method comprising introducing an epigenetic modifying DNA-targeting system that targets a target site within the target region into an HBV infected cell comprising a Hepatitis viral sequence.
226. A method of increasing CpG methylation within a target region in a Hepatitis B viral sequence, the method comprising introducing an epigenetic modifying DNA-targeting system that targets a target site within the target region into an HBV infected cell comprising a Hepatitis viral sequence.
227. A method of promoting epigenetic modification of a target region in a Hepatitis B viral sequence, the method comprising introducing into an HBV infected cell comprising a Hepatitis B viral sequence an epigenetic modifying DNA-targeting system of any of embodiments 1-164, the gRNA of any of embodiments 165-202, the CRISPR Cas-gRNA combination of any of embodiments 203-212, the polynucleotide of embodiment 213, the plurality of polynucleotides of embodiment 214, the vector of any of embodiments 215-224, or a portion or a component of any of the foregoing.
228. A method of increasing CpG methylation of a target region in a Hepatitis B viral sequence, the method comprising introducing into an HBV infected cell comprising a Hepatitis B viral sequence an epigenetic modifying DNA-targeting system of any of embodiments 1-164, the gRNA of any of embodiments 165-202, the CRISPR Cas-gRNA combination of any of embodiments 203-212, the polynucleotide of embodiment 213, the plurality of polynucleotides of embodiment 214, the vector of any of embodiments 215-224, or a portion or a component of any of the foregoing.
229. The method of any of embodiments 225-228, wherein the target region comprises a contiguous sequence of nucleotides within the sequence corresponding to the sequence located at base pairs between 1033 bp-1749 bp in a Hepatitis B viral sequence with reference to nucleotide positions of SEQ ID NO: 650.
230. A method of reducing transcription of one or more genes in an HBV infected cell comprising a Hepatitis B viral sequence, the method comprising introducing into the cell an epigenetic-modifying DNA-targeting system that induces targeted CpG methylation within a Hepatitis B viral sequence with reference to nucleotide positions of SEQ ID NO: 650.
231. A method of reducing Hepatitis B virus infection in an HBV infected cell comprising introducing into a cell comprising a Hepatitis B viral sequence an epigenetic-modifying DNA-targeting system that induces targeted CpG methylation within a target region in a Hepatitis B viral sequence with reference to nucleotide positions of SEQ ID NO: 650.
232. The method of any of embodiments 225-231, wherein the epigenetic modifying DNA-targeting system comprises at least one DNA-targeting module that comprises a fusion protein comprising (a) a DNA-binding domain for targeting a target site in a Hepatitis B viral DNA sequence; and (b) at least one effector domain comprising a DNA methyltransferase effector domain.
233. The method of any of embodiments 226 and 228-232, wherein the region of CpG methylation is within 500 base pairs of the target region.
234. The method of embodiments 225-233, wherein the introducing occurs in vivo in a subject or ex vivo.
235. The method of any of embodiments 225-234, wherein the cell is a mammalian cell.
236. The method of any of embodiments 225-235, wherein the cell is a human cell.
237. The method of any of embodiments 225-236, wherein the cell comprises integrated HBV DNA.
238. The method of any of embodiments 225-237, wherein the cell is a hepatocyte comprising a pool of episomal HBV cccDNA.

239. The method of any of embodiments 238, wherein the hepatocyte expresses HBV proteins, wherein the HBV proteins are HBsAg, HBeAg, or HBcrAg, or combinations of the foregoing.

240. A method of reducing Hepatitis virus infection in a subject comprising administering to a subject infected with Hepatitis B an epigenetic modifying DNA-targeting system that increases CpG methylation within a target region in a Hepatitis B viral sequence, wherein the epigenetic modifying DNA-targeting system comprises (a) a DNA-binding domain for targeting to the target site in a Hepatitis B viral DNA sequence; and (b) at least one effector domain comprising a DNA methyltransferase effector domain.

241. The method of any of embodiments 225-240, wherein the target region is a region that comprises CpGs in the HBV genome.

242. The method of any of embodiments 225-241, wherein the target region comprises a contiguous sequence of nucleotides corresponding to the sequence located at base pairs between 67 bp-392 bp, 1033 bp-1749 bp, or 2215 bp-2490 bp in a Hepatitis B viral sequence with reference to nucleotide positions of SEQ ID NO: 650.

243. The method of any of embodiments 225-242, wherein the target region comprises a contiguous sequence of nucleotides corresponding to the sequence located at base pairs between 1033 bp-1749 bp in a Hepatitis B viral sequence with reference to nucleotide positions of SEQ ID NO: 650.

244. The method of any of embodiments 225-244, wherein the target region is located within 300 base pairs upstream of the hepatitis B X protein (HBx) start codon.

245. The method of any of embodiments 225-244, wherein the target region is within the HBx basal core promoter region.

246. The method of any of embodiments 225-245, wherein the target region is within the HBx promoter/Enhancer region.

247. The method of any of embodiments 225-246, wherein the target region is within 250 base pairs upstream of the hepatitis B X protein (HBx) start codon.

248. The method of any of embodiments 225-247, wherein the target region comprises a contiguous sequence of nucleotides corresponding to the sequence located between base pairs 1060 bp-1480 bp in a Hepatitis B viral sequence with reference to nucleotide positions of SEQ ID NO: 650.

249. The method of any of embodiments 225-248, wherein the target region is within 150 base pairs upstream of the hepatitis B X protein (HBx) start codon.

250. The method of any of embodiments 225-249, wherein the target region is within 120 base pairs upstream of the hepatitis B X protein (HBx) start codon.

251. The method of any of embodiments 225-250, wherein the target region comprises a contiguous sequence of nucleotides corresponding to the sequence located between base pairs 1250 bp-1374 bp in a Hepatitis B viral sequence with reference to nucleotide positions of SEQ ID NO: 650

252. The method of any of embodiments 225-251, wherein the target region comprises a contiguous sequence of nucleotides corresponding to the sequence located between base pairs 1260 bp-1300 bp in a Hepatitis B viral sequence with reference to nucleotide positions of SEQ ID NO: 650

253. The method of embodiments 225-252, wherein the DNA-binding domain comprises a Clustered Regularly Interspaced Short Palindromic Repeats associated (Cas)-guide RNA (gRNA) combination comprising (a) a Cas protein or a variant thereof and (b) at least one gRNA; a zinc finger protein (ZFP); a transcription activator-like effector (TALE); a meganuclease; a homing endonuclease; or an I-SceI enzyme or a variant thereof, optionally wherein the DNA-binding domain comprises a catalytically inactive variant of any of the foregoing.

254. The method of any one of embodiments 225-254, comprising a CRISPR Cas-guide RNA (gRNA) combination comprising:

(a) a Clustered Regularly Interspaced Short Palindromic Repeats associated (Cas) protein or variant thereof; and (b) at least one gRNA of any of embodiments 165-202 that targets the Cas protein or variant thereof to a target site in target site in a Hepatitis B viral DNA sequence.

255. The method of any of embodiments 225-254, wherein the target site, or each of the target sites, comprises the sequence set forth in any one of SEQ ID NOs: 5, 6, 12, 18, 22, 26, 29, 38, 42, 43, 51, 56, 61, 63, 68, 72, 75, 79, 82, 84, 88, 89, 98, 99, 113, 116, 121, 124, 125, 118, 130, 133, 135, 138, 143, 150, 152, 155, 158, 164, 165, 175, 176, 182, 185, 189, 190, 192, a contiguous portion thereof of at least 14 nucleotides (nt), or a complementary sequence of any of the foregoing.

256. The method of any of embodiments 225-255, wherein the target site, or each of the target sites, comprises the sequence set forth in any one of SEQ ID NOs: 12, 18, 20, 22, 26, 27, 46, 50, 63, 66, 73, 79, 185, 192, a contiguous portion thereof of at least 14 nucleotides (nt), or a complementary sequence of any of the foregoing.

257. The method of any of embodiments 225-256, wherein the target site, or each of the target sites, comprises the sequence set forth in SEQ ID NO:22, a contiguous portion thereof of at least 14 nucleotides (nt), or a complementary sequence of any of the foregoing.

258. The method of any of embodiments 225-257, wherein the gRNA, or each of the gRNA, comprises the sequence set forth in any one of SEQ ID NOS: 200, 201, 207, 217, 221, 224, 233, 237, 238, 246, 251, 256, 258, 263, 267, 274, 270, 277, 279, 283, 284, 293, 294, 308, 311, 313, 316, 319, 320, 325, 328, 330, 333, 338, 345, 347, 350, 353, 359, 360, 370, 371, 377, 380, 384, 385, 387, a contiguous portion thereof of at least 14 nucleotides, or a complementary sequence of any of the foregoing, optionally wherein the gRNA, or each of the gRNA, is set forth in any one of SEQ ID NOS: 395, 402, 408, 412, 416, 419, 428, 432, 433, 441, 446, 451, 453, 458, 462, 465, 469, 472, 474, 478, 479, 488, 489, 503, 506, 508, 511, 514, 515, 520, 523, 525, 575, 528, 533, 540, 542, 545, 548, 554, 555, 565, 566, 572, 579, 580, or 582.

259. The method of any of embodiments 225-258, wherein the gRNA, or each of the gRNA, comprises the sequence set forth in any one of SEQ ID NOS: 207, 213, 215, 217, 221, 222, 241, 245, 258, 261, 268, 274, 380, 387, a contiguous portion thereof of at least 14 nucleotides, or a complementary sequence of any of the foregoing, optionally wherein the gRNA, or each of the gRNA, is set forth in any one of SEQ ID NOS: 402, 408, 410, 412, 416, 417, 436, 440, 453, 456, 463, 469, 575, 582.

260. The method of any of embodiments 225-259, wherein the gRNA, or each of the gRNA, comprises the sequence set forth in any one of SEQ ID NO: 217, a contiguous portion thereof of at least 14 nucleotides, or a complementary sequence of any of the foregoing, optionally wherein the gRNA, or each of the gRNA, is set forth in any one of SEQ ID NO: 412.

261. The method of any of embodiments 225-253, wherein the at least one DNA-binding domain comprises an engineered zinc finger protein (eZFP).

262. The method of any of embodiments 225-253 or 261, wherein the target site comprises the nucleotide sequence set forth in any one of SEQ ID NOS: 1045, 1046, 1052, a contiguous portion thereof of at least 12 nt, or a complementary sequence of any of the foregoing.

263. The method of any of embodiments 225-253, or 261-262, wherein the target site comprises the nucleotide sequence set forth in any one of SEQ ID NOS: 1045, 1046, 1052.

264. The method of any of embodiments 225-263, wherein at least one effector domain is a DNA methyltransferase.

265. The method of any of embodiments 225-264, wherein at least one effector domain comprises a DNA methyltransferase and a repressor domain capable of recruiting heterochromatin inducing factors or optionally wherein the heterochromatin inducing factors include a histone methyltransferase.

266. The method of any of embodiments 225-265, wherein the at least one effector domain comprises a DNA methyltransferase and a histone methyltransferase.

267. The method of any of embodiments 225-266, wherein the at least one effector domain comprises a DNMT3A/L domain or a variant thereof.

268. The method of any of embodiments 225-267, wherein the at least one effector domain comprises the sequence set forth in SEQ ID NO: 651 a portion thereof, or an amino acid sequence that has at least 90%, 91%, 92%, 93%, 94%, 95%, 96%, 97%, 98%, or 99% sequence identity to any of the foregoing.

269. The method of any of embodiments 225-268, wherein the at least one effector domain further comprises a KRAB domain or a variant thereof.

270. The method of any of embodiments 225-269, wherein the at least one effector domain further comprises the sequence set forth in SEQ ID NO: 590 a portion thereof, or an amino acid sequence that has at least 90%, 91%, 92%, 93%, 94%, 95%, 96%, 97%, 98%, or 99% sequence identity to any of the foregoing.

271. The method of any of embodiments 225-270, wherein the DNA-targeting system comprises a DNMT3A/3L-dCas9-KRAB domain or a variant thereof.

272. The method of any of embodiments 225-271, wherein the DNA-targeting system comprises the sequence set forth in SEQ ID NO: 645 a portion thereof, or an amino acid sequence that has at least 90%, 91%, 92%, 93%, 94%, 95%, 96%, 97%, 98%, or 99% sequence identity to any of the foregoing.

273. The method of any of embodiments 225-260 or 264-272, wherein the DNA-targeting system comprises the sequence set forth in SEQ ID NO: 680 a portion thereof, or a nucleic acid sequence that has at least 90%, 91%, 92%, 93%, 94%, 95%, 96%, 97%, 98%, or 99% sequence identity to any of the foregoing.

274. The method of any of embodiments 225-260 or 264-273, wherein the DNA-targeting system comprises the sequence set forth in SEQ ID NO: 680.

275. A method of repressing the transcription of one or more genes in Hepatitis B virus infected cell, the method comprising introducing into a Hepatitis B virus infected cell an epigenetic-modifying DNA-targeting system of any of embodiments 1-164, the gRNA of any of embodiments 165-202, the CRISPR Cas-gRNA combination of any of embodiments 203-212, the polynucleotide of embodiment 213, the plurality of polynucleotides of embodiment 214, the vector of any of embodiments 215-224, or a portion or a component of any of the foregoing.

276. The method of embodiment 225-275, wherein the one or more genes are epigenetically modified by the DNA-targeting system.

277. The method of embodiment 225-275, wherein the transcription of the one or more genes is reduced in comparison to a comparable cell not subjected to the method.

278. The method of embodiment 277, wherein the transcription of the one or more genes is reduced by at least about 1.25-fold, 1.5-fold, 1.75-fold, 2.0-fold, 2.5-fold, 2.75-fold, 3.0-fold, 3.5-fold, 3.75-fold, 4.0 fold, 4.5-fold, 4.75-fold, 5.0-fold, 5.25-fold, 5.5-fold, 5.75-fold, 6-fold.

279. The method of any of embodiments 225-278, wherein repressing transcription of the one or more genes results in reduced HBV replication and/or HBV transcription.

280. The method of any of embodiments 225-279, wherein the HBV infected cell is a mammalian cell.

281. The method of any of embodiments 225-280, wherein the HBV infected cell is a human cell.

282. The method of any of embodiments 225-281, wherein the cell comprises integrated HBV DNA.

283. The method of any of embodiments 225-282, wherein the cell is a hepatocyte comprising a pool of episomal HBV cccDNA.

284. The method of any of embodiments 225-283, wherein the hepatocyte expresses HBV proteins, wherein the HBV proteins are HBsAg, and/or HBeAg.

285. The method of any of embodiments 225-284, wherein the HBV infected cells in present in a subject.

286. The method of any of embodiments 225-285, wherein the subject is a human.

287. The method of any of embodiments 225-286, wherein the subject has an HBV viral infection.

288. The method of any of embodiments 225-288, wherein the subject has hepatocytes comprising integrated HBV DNA.

289. The method of any of embodiments 225-288, wherein the subject has hepatocytes comprising a pool of episomal HBV cccDNA.

290. The method of any of embodiments 225-289, wherein the subject has hepatocytes expressing HBV proteins, wherein the HBV proteins are HBsAg, HBeAg, or HBcrAg and combinations thereof.

291. The method of any of embodiments 225-290, wherein the subject has a disease, condition or disorder associated with the HBV viral infection.

292. The method of any of embodiments 291, wherein the disease, condition, or disorder is a liver disease or a cancer.
293. The method of any of embodiments 291 or embodiment 292, wherein the disease, condition, or disorder is acute hepatitis, chronic hepatitis, liver failure, or liver cirrhosis.
294. The method of any of embodiments 291-293, wherein the disease, condition, or disorder is cancer, optionally wherein the cancer is hepatocellular cancer.
295. A pharmaceutical composition comprising the vector of any of embodiments 215-224.
296. The pharmaceutical composition of embodiment 295, wherein the vector is conjugated to an amino sugar derivative of galactose, optionally wherein the vector is conjugated to an N-Acetylegalactosamine (GalNAc) moiety.
297. A pharmaceutical composition comprising the epigenetic-modifying DNA-targeting system of any of embodiments 1-164 or the fusion protein of any of embodiments 1-164, the gRNA of any of embodiments 165-202, the CRISPR Cas-gRNA combination of any of embodiments 203-212, the polynucleotide of embodiment 213, the plurality of polynucleotides of embodiment 214, the vector of any of embodiments 215-224, or a portion or a component of any of the foregoing.
298. The pharmaceutical composition of embodiment 295-297, for use in treating an HBV viral infection in a subject.
299. The pharmaceutical composition of any of embodiments 295-298, wherein the subject has a disease, condition or disorder associated with the HBV viral infection.
300. The pharmaceutical composition of embodiment 295-299, for use in treating a disease, disorder or condition in a subject associated with an HBV viral infection.
301. The pharmaceutical composition of any of embodiments 295-300, for use in the manufacture of a medicament for treating an HBV viral infection in a subject.
302. The pharmaceutical composition for use of any of embodiments 298-301, wherein the HBV viral infection is associated with a disease, disorder or condition.
303. The pharmaceutical composition of any of embodiments 295-300, for use in the manufacture of a medicament for treating a disease, condition, or disorder in a subject associated with an HBV viral infection.
304. The pharmaceutical composition of embodiments 299, 300, 302 or 303, wherein the disease, condition, or disorder is liver disease or a cancer.
305. The pharmaceutical composition of embodiments 299, 300, 302 or 303, wherein the disease, condition, or disorder is acute hepatitis, chronic hepatitis, liver failure, or liver cirrhosis.
306. The pharmaceutical composition of embodiments 299, 300, 302 303 or 304, wherein the disease, condition, or disorder is cancer, optionally hepatocellular cancer.
307. The pharmaceutical composition of any of embodiments 295-306, wherein the pharmaceutical composition is to be administered to the subject in vivo.
308. The pharmaceutical composition of any of embodiments 295-307, wherein following administration of the pharmaceutical composition, transcription of one or more HBV genes is repressed in cells of the subject.
309. The pharmaceutical composition of embodiment 308, wherein the one or more HBV genes are involved in controlling HBV replication and/or HBV transcription.
310. The pharmaceutical composition of embodiment 308 or 309, wherein the one or more genes is a polymerase gene, S-family gene, X-gene, or core family gene.
311. A method for treating a disease, condition, or disorder in a subject in need thereof, comprising administering to the subject the epigenetic-modifying DNA-targeting system of any of embodiments 1-164, the gRNA of any of embodiments 165-202, the CRISPR Cas-gRNA combination of any of embodiments 203-212, the polynucleotide of embodiment 213, the plurality of polynucleotides of embodiment 214, the vector of any of embodiments 215-224, the pharmaceutical composition of any of embodiments 297-310, or a portion or a component of any of the foregoing.
312. A method of reducing Hepatitis B virus infection in a subject comprising administering to a subject that has a Hepatitis B virus infection, the epigenetic-modifying DNA-targeting system of any of embodiments 1-164, the gRNA of any of embodiments 165-202, the CRISPR Cas-gRNA combination of any of embodiments 203-212, the polynucleotide of embodiment 213, the plurality of polynucleotides of embodiment 214, the vector of any of embodiments 215-224, the pharmaceutical composition of any of embodiments 297-310, or a portion or a component of any of the foregoing.
313. An engineered zinc finger protein (eZFP) that binds to a target site in one or more HBV genes or regulatory elements thereof, wherein the target site is within a target region that has a sequence corresponding to the sequence located at base pairs between 1033 bp-1749 bp of the HBV genome with reference to the HBV genome set forth in SEQ ID NO: 650.
314. The eZFP of embodiment 313, wherein the target site is within a target region spanning within 300 base pairs upstream of the hepatitis B X protein (HBx) start codon.
315. The eZFP of embodiment 313 or embodiment 314, wherein the target site is positioned in the HBx basal core promoter region.
316. The eZFP of embodiment 313 or embodiment 314, wherein the target site is positioned within the HBx promoter/Enhancer region.
317. The eZFP of any of embodiments 313-316, wherein the target site is within a target region spanning within 250 base pairs upstream of the hepatitis B X protein (HBx) start codon.
318. The eZFP of any of embodiments 313-317, wherein the target site is within a target region that has a sequence corresponding to the sequence located at base pairs between 1060-1480 bp of the HBV genome with reference to the HBV genome set forth in SEQ ID NO: 650.
319. The eZFP of any of embodiments 313-318, wherein the target site is within a target region spanning within 150 base pairs upstream of the hepatitis B X protein (HBx) start codon.
320. The eZFP of any of embodiments 313-319, wherein the target site is within a target region spanning within 120 base pairs upstream of the hepatitis B X protein (HBx) start codon.
321. The eZFP of any of embodiments 313-320, wherein the target site is within a target region has a sequence corresponding to the sequence located at base pairs between 1250-1374 bp of the HBV genome with reference to the HBV genome set forth in SEQ ID NO: 650.

322. The eZFP of any of embodiments 313-321, wherein the target site is within a target region that has a sequence corresponding to the sequence located at base pairs between 1255-1302 bp of the HBV genome with reference to the HBV genome set forth in SEQ ID NO: 650.

323. The eZFP of any of embodiments 313-322, wherein the target site is within a target region that has a sequence corresponding to the sequence located at base pairs between 1260-1300 bp of the HBV genome with reference to the HBV genome set forth in SEQ ID NO: 650.

324. The eZFP of embodiment 323, wherein the target site is within a target region that has a sequence corresponding to the sequence located at base pairs between 1255 bp-1290 bp of the HBV genome with reference to the HBV genome set forth in SEQ ID NO: 650.

325. The eZFP of any of embodiments 313-324, wherein the target site comprises the nucleotide sequence set forth in any one of SEQ ID NOS: 1028-1055, a contiguous portion thereof of at least 12 nt, or a complementary sequence of any of the foregoing.

326. The eZFP of any of embodiments 313-325, wherein the target site comprises the nucleotide sequence set forth in any one of SEQ ID NOS: 1028-1055.

327. The eZFP of any of embodiments 313-326, wherein the target site comprises the nucleotide sequence set forth in any one of SEQ ID NOS: 1045, 1046, or 1052, a contiguous portion thereof of at least 12 nt, or a complementary sequence of any of the foregoing.

328. The eZFP of any of embodiments 313-326, wherein the target site comprises the nucleotide sequence set forth in any one of SEQ ID NOS: 1045, 1046, or 1052.

329. The eZFP of any of embodiments 313-328, wherein the zinc finger protein comprises six zinc fingers denoted F1 through F6 in order from N-terminus to C-terminus, and wherein the amino acid sequence of each zinc finger recognition region is as follows:

1)
F1:
SEADRSR (SEQ ID NO: 720)

F2:
DRSNLTR (SEQ ID NO: 721)

F3:
QSSDLSR (SEQ ID NO: 722)

F4:
YHWYLKK (SEQ ID NO: 723)

F5:
RSDSLSV (SEQ ID NO: 724)

F6:
QNANRKT; (SEQ ID NO: 725)

2)
F1:
RSDVLST (SEQ ID NO: 726)

F2:
DNSSRTR (SEQ ID NO: 727)

F3:
RPYTLRL (SEQ ID NO: 728)

F4:
DSSHRTR (SEQ ID NO: 729)

F5:
RSDHLSQ (SEQ ID NO: 730)

F6:
DSSHRTR; (SEQ ID NO: 731)

3)
F1:
RSDHLSQ (SEQ ID NO: 732)

F2:
QSADRTK (SEQ ID NO: 733)

F3:
RSDHLSQ (SEQ ID NO: 734)

F4:
RRSDLKR (SEQ ID NO: 735)

F5:
RSDHLSR (SEQ ID NO: 736)

F6:
QSSDLRR; (SEQ ID NO: 737)

4)
F1:
RSDNLSE (SEQ ID NO: 738)

F2:
TSSNRKT (SEQ ID NO: 739)

F3:
DRSHLTR (SEQ ID NO: 740)

F4:
RSDALTQ (SEQ ID NO: 741)

F5:
DRSALAR (SEQ ID NO: 742)

F6:
RRFTLSK; (SEQ ID NO: 743)

5)
F1:
RSDHLSE (SEQ ID NO: 744)

F2:
QYSGRYY (SEQ ID NO: 745)

F3:
HGQTLNE (SEQ ID NO: 746)

F4:
QSGNLAR (SEQ ID NO: 747)

F5:
RSDSLLR (SEQ ID NO: 748)

F6:
CREYRGK; (SEQ ID NO: 749)

6)
F1:
QSANRTT (SEQ ID NO: 750)

F2:
RSANLTR (SEQ ID NO: 751)

F3:
RSDVLSE (SEQ ID NO: 752)

F4:
TSGHLSR (SEQ ID NO: 753)

F5:
QSSDLSR, (SEQ ID NO: 754)

F6:
QWSTRKR; (SEQ ID NO: 755)

7)
F1:
QSGNLAR (SEQ ID NO: 756)

F2:
ATCCLAH (SEQ ID NO: 757)

F3:
RWQYLPT (SEQ ID NO: 758)

F4:
DRSALAR (SEQ ID NO: 759)

F5:
RSDNLSE (SEQ ID NO: 760)

F6:
KRCNLRC; (SEQ ID NO: 761)

8)
F1:
NPANLTR (SEQ ID NO: 762)

F2:
QNATRTK (SEQ ID NO: 763)

F3:
QSGHLAR (SEQ ID NO: 764)

F4:
NRHDRAK (SEQ ID NO: 765)

F5:
RSDHLSE, (SEQ ID NO: 766)

F6:
QRRSRYK; (SEQ ID NO: 767)

9)
F1:
QSSDLSR (SEQ ID NO: 768)

F2:
HRSTRNR (SEQ ID NO: 769)

F3:
RSDVLSA (SEQ ID NO: 770)

F4:
DSRTRKN (SEQ ID NO: 771)

F5:
QSGSLTR (SEQ ID NO: 772)

F6:
DQSGLAH; (SEQ ID NO: 773)

10)
F1:
QNPAQWR (SEQ ID NO: 774)

F2:
RSADLSR (SEQ ID NO: 775)

F3:
TSGSLSR (SEQ ID NO: 776)

F4:
RSDHLSR (SEQ ID NO: 777)

F5:
RSDSLLR (SEQ ID NO: 778)

F6:
QSYDRFQ; (SEQ ID NO: 779)

11)
F1:
TSGSLSR (SEQ ID NO: 780)

F2:
RSDHLSR (SEQ ID NO: 781)

F3:
RSDSLLR (SEQ ID NO: 782)

12)
F1: DRSNLSR (SEQ ID NO: 786)
F2: LRQNLIM (SEQ ID NO: 787)
F3: ERGTLAR (SEQ ID NO: 788)
F4: RSDALTQ (SEQ ID NO: 789)
F5: RSDSLSQ (SEQ ID NO: 790)
F6: RKADRTR; (SEQ ID NO: 791)

13)
F1: QYCCLTN (SEQ ID NO: 792)
F2: TSGNLTR (SEQ ID NO: 793)
F3: QSSDLSR (SEQ ID NO: 794)
F4: FRYYLKR (SEQ ID NO: 795)
F5: QSGDLTR (SEQ ID NO: 796)
F6: DKGNLTK; (SEQ ID NO: 797)

14)
F1: TSGSLSR (SEQ ID NO: 798)
F2: RSDNLTT (SEQ ID NO: 799)
F3: QSGNLAR (SEQ ID NO: 800)
F4: DRTTLMR (SEQ ID NO: 801)
F5: QSGHLAR (SEQ ID NO: 802)
F6: QLTHLNS; (SEQ ID NO: 803)

15)
F1: IKHDLHR (SEQ ID NO: 804)
F2: RSANLTR (SEQ ID NO: 805)
F3: RSDNLAR (SEQ ID NO: 806)
F4: QNVSRPR (SEQ ID NO: 807)
F5: RSDDLSK (SEQ ID NO: 808)
F6: DSSHRTR; (SEQ ID NO: 809)

16)
F1: RSDNLAR (SEQ ID NO: 810)
F2: QNVSRPR (SEQ ID NO: 811)
F3: RSDDLSK (SEQ ID NO: 812)
F4: DSSHRTR (SEQ ID NO: 813)
F5: TSSNRKT (SEQ ID NO: 814)
F6: AQWTRAC; (SEQ ID NO: 815)

17)
F1: RSDDLSK (SEQ ID NO: 816)
F2: DSSHRTR (SEQ ID NO: 817)
F3: TSSNRKT (SEQ ID NO: 818)
F4: AQWTRAC (SEQ ID NO: 819)
F5: RKQTRTT (SEQ ID NO: 820)

-continued

F6:
HRSSLRR; (SEQ ID NO: 821)

18)
F1:
QSAHRKN (SEQ ID NO: 822)

F2:
TSSNRKT (SEQ ID NO: 823)

F3:
RSDNLSA (SEQ ID NO: 824)

F4:
RNNDRKT (SEQ ID NO: 825)

F5:
TSGSLSR (SEQ ID NO: 826)

F6:
QAGHLAK; (SEQ ID NO: 827)

19)
F1:
RSDHLSQ (SEQ ID NO: 828)

F2:
ASSTRTK (SEQ ID NO: 829)

F3:
RSDDLTR (SEQ ID NO: 830)

F4:
QKSNLSS (SEQ ID NO: 831)

F5:
QSANRTT (SEQ ID NO: 832)

F6:
QNATRTK; (SEQ ID NO: 833)

20)
F1:
RSDTLSE (SEQ ID NO: 834)

F2:
RRWTLVG (SEQ ID NO: 835)

F3:
DRSNLSR (SEQ ID NO: 836)

F4:
QSGDLTR (SEQ ID NO: 837)

F5:
QSSDLSR (SEQ ID NO: 838)

F6:
YHWYLKK; (SEQ ID NO: 839)

21)
F1:
RSANLAR (SEQ ID NO: 840)

F2:
RSDNLRE (SEQ ID NO: 841)

F3:
RPYTLRL (SEQ ID NO: 842)

F4:
HRSNLNK (SEQ ID NO: 843)

F5:
QSGSLTR (SEQ ID NO: 844)

F6:
TSANLSR; (SEQ ID NO: 845)

22)
F1:
RSDDLVR (SEQ ID NO: 846)

F2:
TSGSLVR (SEQ ID NO: 847)

F3:
RSDKLVR (SEQ ID NO: 848)

F4:
RSDELVR (SEQ ID NO: 849)

F5:
TSHSLTE (SEQ ID NO: 850)

F6:
RADNLTE; (SEQ ID NO: 851)

23)
F1:
ERSHLRE (SEQ ID NO: 852)

F2:
TSHSLTE (SEQ ID NO: 853)

F3:
QAGHLAS (SEQ ID NO: 854)

F4:
TSHSLTE (SEQ ID NO: 855)

F5:
DPGHLVR (SEQ ID NO: 856)

F6:
TSGNLVR; (SEQ ID NO: 857)

24)
F1:
RADNLTE (SEQ ID NO: 858)

25)
F1: QSSSLVR (SEQ ID NO: 864)
F2: QSGDLRR (SEQ ID NO: 865)
F3: RSDERKR (SEQ ID NO: 866)
F4: HRTTLTN (SEQ ID NO: 867)
F5: RSDHLTN (SEQ ID NO: 868)
F6: TSGELVR; (SEQ ID NO: 869)

26)
F1: QSGDLRR (SEQ ID NO: 870)
F2: RSDERKR (SEQ ID NO: 871)
F3: HRTTLTN (SEQ ID NO: 872)
F4: RSDHLTN (SEQ ID NO: 873)
F5: TSGELVR (SEQ ID NO: 874)
F6: RSDDLVR; (SEQ ID NO: 875)

27)
F1: QRAHLER (SEQ ID NO: 876)
F2: QLAHLRA (SEQ ID NO: 877)
F3: DPGHLVR (SEQ ID NO: 878)
F4: RRSACRR (SEQ ID NO: 879)
F5: RSDHLTT (SEQ ID NO: 880)
F6: QSSSLVR; and (SEQ ID NO: 881)

28)
F1: QSSNLVR (SEQ ID NO: 882)
F2: RSDDLVR (SEQ ID NO: 883)
F3: THLDLIR (SEQ ID NO: 884)
F4: TSGNLTE (SEQ ID NO: 885)
F5: RRSACRR (SEQ ID NO: 886)
F6: RNDTLTE. (SEQ ID NO: 887)

330. The eZFP of any of embodiments 313-329, wherein the zinc finger protein comprises six zinc fingers denoted F1 through F6 in order from N-terminus to C-terminus, and wherein the amino acid sequence of each zinc finger recognition region is as follows:

F1: QSAHRKN (SEQ ID NO: 822)
F2: TSSNRKT (SEQ ID NO: 823)
F3: RSDNLSA (SEQ ID NO: 824)
F4: RNNDRKT (SEQ ID NO: 825)
F5: TSGSLSR (SEQ ID NO: 826)
F6: QAGHLAK. (SEQ ID NO: 827)

331. The eZFP of any of embodiments 313-329, wherein the zinc finger protein comprises six zinc fingers denoted F1 through F6 in order from N-terminus to C-terminus, and wherein the amino acid sequence of each zinc finger recognition region is as follows:

F1:
RSDHLSQ (SEQ ID NO: 828)

F2:
ASSTRTK (SEQ ID NO: 829)

F3:
RSDDLTR (SEQ ID NO: 830)

F4:
QKSNLSS (SEQ ID NO: 831)

F5:
QSANRTT (SEQ ID NO: 832)

F6:
QNATRTK. (SEQ ID NO: 833)

332. The eZFP of any of embodiments 313-329, wherein the zinc finger protein comprises six zinc fingers denoted F1 through F6 in order from N-terminus to C-terminus, and wherein the amino acid sequence of each zinc finger recognition region is as follows:

F1:
QSSSLVR (SEQ ID NO: 864)

F2:
QSGDLRR (SEQ ID NO: 865)

F3:
RSDERKR (SEQ ID NO: 866)

F4:
HRTTLTN (SEQ ID NO: 867)

F5:
RSDHLTN (SEQ ID NO: 868)

F6:
TSGELVR. (SEQ ID NO: 869)

333. An eZFP that binds to a target site in one or more HBV genes or regulatory elements thereof, wherein the zinc finger protein comprises six zinc fingers denoted F1 through F6 in order from N-terminus to C-terminus, and wherein the amino acid sequence of each zinc finger recognition region is as follows:

1)
F1:
SEADRSR (SEQ ID NO: 720)

F2:
DRSNLTR (SEQ ID NO: 721)

F3:
QSSDLSR (SEQ ID NO: 722)

F4:
YHWYLKK (SEQ ID NO: 723)

F5:
RSDSLSV (SEQ ID NO: 724)

F6:
QNANRKT; (SEQ ID NO: 725)

2)
F1:
RSDVLST (SEQ ID NO: 726)

F2:
DNSSRTR (SEQ ID NO: 727)

F3:
RPYTLRL (SEQ ID NO: 728)

F4:
DSSHRTR (SEQ ID NO: 729)

F5:
RSDHLSQ (SEQ ID NO: 730)

F6:
DSSHRTR; (SEQ ID NO: 731)

3)
F1:
RSDHLSQ (SEQ ID NO: 732)

F2:
QSADRTK (SEQ ID NO: 733)

F3:
RSDHLSQ (SEQ ID NO: 734)

F4:
RRSDLKR (SEQ ID NO: 735)

F5:
RSDHLSR (SEQ ID NO: 736)

F6:
QSSDLRR; (SEQ ID NO: 737)

4)
F1:
RSDNLSE (SEQ ID NO: 738)

F2:
TSSNRKT (SEQ ID NO: 739)

F3:
DRSHLTR (SEQ ID NO: 740)

F4:
RSDALTQ (SEQ ID NO: 741)

-continued

F5:
DRSALAR (SEQ ID NO: 742)

F6:
RRFTLSK; (SEQ ID NO: 743)

5)
F1:
RSDHLSE (SEQ ID NO: 744)

F2:
QYSGRYY (SEQ ID NO: 745)

F3:
HGQTLNE (SEQ ID NO: 746)

F4:
QSGNLAR (SEQ ID NO: 747)

F5:
RSDSLLR (SEQ ID NO: 748)

F6:
CREYRGK; (SEQ ID NO: 749)

6)
F1:
QSANRTT (SEQ ID NO: 750)

F2:
RSANLTR (SEQ ID NO: 751)

F3:
RSDVLSE (SEQ ID NO: 752)

F4:
TSGHLSR (SEQ ID NO: 753)

F5:
QSSDLSR, (SEQ ID NO: 754)

F6:
QWSTRKR; (SEQ ID NO: 755)

7)
F1:
QSGNLAR (SEQ ID NO: 756)

F2:
ATCCLAH (SEQ ID NO: 757)

F3:
RWQYLPT (SEQ ID NO: 758)

F4:
DRSALAR (SEQ ID NO: 759)

F5:
RSDNLSE (SEQ ID NO: 760)

-continued

F6:
KRCNLRC; (SEQ ID NO: 761)

8)
F1:
NPANLTR (SEQ ID NO: 762)

F2:
QNATRTK (SEQ ID NO: 763)

F3:
QSGHLAR (SEQ ID NO: 764)

F4:
NRHDRAK (SEQ ID NO: 765)

F5:
RSDHLSE, (SEQ ID NO: 766)

F6:
QRRSRYK; (SEQ ID NO: 767)

9)
F1:
QSSDLSR (SEQ ID NO: 768)

F2:
HRSTRNR (SEQ ID NO: 769)

F3:
RSDVLSA (SEQ ID NO: 770)

F4:
DSRTRKN (SEQ ID NO: 771)

F5:
QSGSLTR (SEQ ID NO: 772)

F6:
DQSGLAH; (SEQ ID NO: 773)

10)
F1:
QNPAQWR (SEQ ID NO: 774)

F2:
RSADLSR (SEQ ID NO: 775)

F3:
TSGSLSR (SEQ ID NO: 776)

F4:
RSDHLSR (SEQ ID NO: 777)

F5:
RSDSLLR (SEQ ID NO: 778)

F6:
QSYDRFQ; (SEQ ID NO: 779)

11)
F1:
TSGSLSR (SEQ ID NO: 780)
F2:
RSDHLSR (SEQ ID NO: 781)
F3:
RSDSLLR (SEQ ID NO: 782)
F4:
QSYDRFQ (SEQ ID NO: 783)
F5:
RSDNLST (SEQ ID NO: 784)
F6:
DNRDRIK; (SEQ ID NO: 785)

12)
F1:
DRSNLSR (SEQ ID NO: 786)
F2:
LRQNLIM (SEQ ID NO: 787)
F3:
ERGTLAR (SEQ ID NO: 788)
F4:
RSDALTQ (SEQ ID NO: 789)
F5:
RSDSLSQ (SEQ ID NO: 790)
F6:
RKADRTR; (SEQ ID NO: 791)

13)
F1:
QYCCLTN (SEQ ID NO: 792)
F2:
TSGNLTR (SEQ ID NO: 793)
F3:
QSSDLSR (SEQ ID NO: 794)
F4:
FRYYLKR (SEQ ID NO: 795)
F5:
QSGDLTR (SEQ ID NO: 796)
F6:
DKGNLTK; (SEQ ID NO: 797)

14)
F1:
TSGSLSR (SEQ ID NO: 798)
F2:
RSDNLTT (SEQ ID NO: 799)
F3:
QSGNLAR (SEQ ID NO: 800)
F4:
DRTTLMR (SEQ ID NO: 801)
F5:
QSGHLAR (SEQ ID NO: 802)
F6:
QLTHLNS; (SEQ ID NO: 803)

15)
F1:
IKHDLHR (SEQ ID NO: 804)
F2:
RSANLTR (SEQ ID NO: 805)
F3:
RSDNLAR (SEQ ID NO: 806)
F4:
QNVSRPR (SEQ ID NO: 807)
F5:
RSDDLSK (SEQ ID NO: 808)
F6:
DSSHRTR; (SEQ ID NO: 809)

16)
F1:
RSDNLAR (SEQ ID NO: 810)
F2:
QNVSRPR (SEQ ID NO: 811)
F3:
RSDDLSK (SEQ ID NO: 812)
F4:
DSSHRTR (SEQ ID NO: 813)
F5:
TSSNRKT (SEQ ID NO: 814)
F6:
AQWTRAC; (SEQ ID NO: 815)

17)
F1:
RSDDLSK (SEQ ID NO: 816)
F2:
DSSHRTR (SEQ ID NO: 817)

F3:
TSSNRKT (SEQ ID NO: 818)

F4:
AQWTRAC (SEQ ID NO: 819)

F5:
RKQTRTT (SEQ ID NO: 820)

F6:
HRSSLRR; (SEQ ID NO: 821)

18)
F1:
QSAHRKN (SEQ ID NO: 822)

F2:
TSSNRKT (SEQ ID NO: 823)

F3:
RSDNLSA (SEQ ID NO: 824)

F4:
RNNDRKT (SEQ ID NO: 825)

F5:
TSGSLSR (SEQ ID NO: 826)

F6:
QAGHLAK; (SEQ ID NO: 827)

19)
F1:
RSDHLSQ (SEQ ID NO: 828)

F2:
ASSTRTK (SEQ ID NO: 829)

F3:
RSDDLTR (SEQ ID NO: 830)

F4:
QKSNLSS (SEQ ID NO: 831)

F5:
QSANRTT (SEQ ID NO: 832)

F6:
QNATRTK; (SEQ ID NO: 833)

20)
F1:
RSDTLSE (SEQ ID NO: 834)

F2:
RRWTLVG (SEQ ID NO: 835)

F3:
DRSNLSR (SEQ ID NO: 836)

F4:
QSGDLTR (SEQ ID NO: 837)

F5:
QSSDLSR (SEQ ID NO: 838)

F6:
YHWYLKK; (SEQ ID NO: 839)

21)
F1:
RSANLAR (SEQ ID NO: 840)

F2:
RSDNLRE (SEQ ID NO: 841)

F3:
RPYTLRL (SEQ ID NO: 842)

F4:
HRSNLNK (SEQ ID NO: 843)

F5:
QSGSLTR (SEQ ID NO: 844)

F6:
TSANLSR; (SEQ ID NO: 845)

22)
F1:
RSDDLVR (SEQ ID NO: 846)

F2:
TSGSLVR (SEQ ID NO: 847)

F3:
RSDKLVR (SEQ ID NO: 848)

F4:
RSDELVR (SEQ ID NO: 849)

F5:
TSHSLTE (SEQ ID NO: 850)

F6:
RADNLTE; (SEQ ID NO: 851)

23)
F1:
ERSHLRE (SEQ ID NO: 852)

F2:
TSHSLTE (SEQ ID NO: 853)

F3:
QAGHLAS (SEQ ID NO: 854)

F4:
TSHSLTE (SEQ ID NO: 855)

F5:
DPGHLVR (SEQ ID NO: 856)

F6:
TSGNLVR; (SEQ ID NO: 857)

24)
F1:
RADNLTE (SEQ ID NO: 858)

F2:
TSGSLVR (SEQ ID NO: 859)

F3:
RKDNLKN (SEQ ID NO: 860)

F4:
QSSSLVR (SEQ ID NO: 861)

F5:
RSDKLVR (SEQ ID NO: 862)

F6:
DSGNLRV; (SEQ ID NO: 863)

25)
F1:
QSSSLVR (SEQ ID NO: 864)

F2:
QSGDLRR (SEQ ID NO: 865)

F3:
RSDERKR (SEQ ID NO: 866)

F4:
HRTTLTN (SEQ ID NO: 867)

F5:
RSDHLTN (SEQ ID NO: 868)

F6:
TSGELVR; (SEQ ID NO: 869)

26)
F1:
QSGDLRR (SEQ ID NO: 870)

F2:
RSDERKR (SEQ ID NO: 871)

F3:
HRTTLTN (SEQ ID NO: 872)

F4:
RSDHLTN (SEQ ID NO: 873)

F5:
TSGELVR (SEQ ID NO: 874)

F6:
RSDDLVR; (SEQ ID NO: 875)

27)
F1:
QRAHLER (SEQ ID NO: 876)

F2:
QLAHLRA (SEQ ID NO: 877)

F3:
DPGHLVR (SEQ ID NO: 878)

F4:
RRSACRR (SEQ ID NO: 879)

F5:
RSDHLTT (SEQ ID NO: 880)

F6:
QSSSLVR; (SEQ ID NO: 881)
and

28)
F1:
QSSNLVR (SEQ ID NO: 882)

F2:
RSDDLVR (SEQ ID NO: 883)

F3:
THLDLIR (SEQ ID NO: 884)

F4:
TSGNLTE (SEQ ID NO: 885)

F5:
RRSACRR (SEQ ID NO: 886)

F6:
RNDTLTE. (SEQ ID NO: 887)

334. The eZFP of any of embodiments 313-333, wherein the engineered zinc finger protein comprises the sequence set forth in any one of SEQ ID NOS: 692-719, or a portion thereof, or an amino acid sequence that has at least 90%, 91%, 92%, 93%, 94%, 95%, 96%, 97%, 98%, or 99% sequence identity thereto.

335. The eZFP of any of embodiments 313-334, wherein the engineered zinc finger protein is encoded by the sequence set forth in any one of SEQ ID NOS:888-915, or a portion thereof, or nucleotide sequence that has at least 90%, 91%, 92%, 93%, 94%, 95%, 96%, 97%, 98%, or 99% sequence identity thereto.

336. An engineered zinc finger protein that binds to a target site in one or more HBV genes or regulatory elements thereof, wherein the zinc finger protein comprises six zinc fingers denoted F1 through F6 in order from N-terminus to C-terminus, and wherein the amino acid sequence of each zinc finger recognition region is as follows:

```
F1:
                                (SEQ ID NO: 822)
QSAHRKN

F2:
                                (SEQ ID NO: 823)
TSSNRKT

F3:
                                (SEQ ID NO: 824)
RSDNLSA

F4:
                                (SEQ ID NO: 825)
RNNDRKT

F5:
                                (SEQ ID NO: 826)
TSGSLSR

F6:
                                (SEQ ID NO: 827)
QAGHLAK.
```

337. The eZFP of any of embodiments 313-336, wherein the engineered zinc finger protein comprises the sequence set forth in SEQ ID NO: 709, or a portion thereof, or an amino acid sequence that has at least 90%, 91%, 92%, 93%, 94%, 95%, 96%, 97%, 98%, or 99% sequence identity thereto.

338. The eZFP of any of embodiments 313-337, wherein the engineered zinc finger protein comprises the sequence set forth in any one of SEQ ID NOS: 709.

339. The eZFP of any of embodiments 313-338, wherein the engineered zinc finger protein is encoded by the sequence set forth in SEQ ID NO:905, or a portion thereof, or nucleotide sequence that has at least 90%, 91%, 92%, 93%, 94%, 95%, 96%, 97%, 98%, or 99% sequence identity thereto.

340. The eZFP of any of embodiments 313-339, wherein the engineered zinc finger protein is encoded by the sequence set forth in any one of SEQ ID NOS:905.

341. An engineered zinc finger protein that binds to a target site in one or more HBV genes or regulatory elements thereof, wherein the zinc finger protein comprises six zinc fingers denoted F1 through F6 in order from N-terminus to C-terminus, and wherein the amino acid sequence of each zinc finger recognition region is as follows:

```
F1:
                                (SEQ ID NO: 828)
RSDHLSQ

F2:
                                (SEQ ID NO: 829)
ASSTRTK

F3:
                                (SEQ ID NO: 830)
RSDDLTR

F4:
                                (SEQ ID NO: 831)
QKSNLSS

F5:
                                (SEQ ID NO: 832)
QSANRTT

F6:
                                (SEQ ID NO: 833)
QNATRTK.
```

342. The eZFP of any of embodiments 313-335 and 341, wherein the engineered zinc finger protein comprises the sequence set forth in SEQ ID NO: 710, or a portion thereof, or an amino acid sequence that has at least 90%, 91%, 92%, 93%, 94%, 95%, 96%, 97%, 98%, or 99% sequence identity thereto.

343. The eZFP of any of embodiments 313-335, 341 and 342, wherein the engineered zinc finger protein comprises the sequence set forth in any one of SEQ ID NOS: 710

344. The eZFP of any of embodiments 313-335 and 341-343, wherein the engineered zinc finger protein is encoded by the sequence set forth in SEQ ID NO:906, or a portion thereof, or nucleotide sequence that has at least 90%, 91%, 92%, 93%, 94%, 95%, 96%, 97%, 98%, or 99% sequence identity thereto.

345. The eZFP of any of embodiments 313-335 and 341-344, wherein the engineered zinc finger protein is encoded by the sequence set forth in any one of SEQ ID NOS: 906.

346. An engineered zinc finger protein that binds to a target site in one or more HBV genes or regulatory elements thereof, wherein the zinc finger protein comprises six zinc fingers denoted F1 through F6 in order from N-terminus to C-terminus, and wherein the amino acid sequence of each zinc finger recognition region is as follows:

```
F1:
                                (SEQ ID NO: 864)
QSSSLVR

F2:
                                (SEQ ID NO: 865)
QSGDLRR

F3:
                                (SEQ ID NO: 866)
RSDERKR

F4:
                                (SEQ ID NO: 867)
HRTTLTN

F5:
                                (SEQ ID NO: 868)
RSDHLTN

F6:
                                (SEQ ID NO: 869)
TSGELVR.
```

347. The eZFP of any of embodiments 313-335 and 346, wherein the engineered zinc finger protein comprises the sequence set forth in SEQ ID NO: 716, or a portion thereof, or an amino acid sequence that has at least 90%, 91%, 92%, 93%, 94%, 95%, 96%, 97%, 98%, or 99% sequence identity thereto.

348. The eZFP of any of embodiments 313-335, 346 and 347, wherein the engineered zinc finger protein comprises the sequence set forth in any one of SEQ ID NOS: 716.

349. The eZFP of any of embodiments 313-335 and 346-348, wherein the engineered zinc finger protein is encoded by the sequence set forth in SEQ ID NO:912, or a portion thereof, or nucleotide sequence that has at least 90%, 91%, 92%, 93%, 94%, 95%, 96%, 97%, 98%, or 99% sequence identity thereto.

350. The eZFP of any of embodiments 313-335 and 346-349, wherein the engineered zinc finger protein is encoded by the sequence set forth in any one of SEQ ID NOS:912.

Also among the provided embodiments are:

1. An epigenetic-modifying DNA-targeting system comprising at least one DNA-targeting module for repressing transcription of one or more Hepatitis B viral (HBV) genes, wherein each of the at least one DNA-targeting module comprises a fusion protein comprising:
   (a) a DNA-binding domain for targeting to a target site in a Hepatitis B viral DNA sequence, wherein the target site is within a target region that has a sequence corresponding to the sequence located at base pairs between 1033 bp-1749 bp in a Hepatitis B viral sequence with reference to nucleotide positions of SEQ ID NO: 650; and
   (b) at least one transcriptional repressor effector domain.
2. The epigenetic-modifying DNA-targeting system of embodiment 1, wherein the target site is within a target region located within 300 base pairs upstream of the hepatitis B X protein (HBx) start codon.
3. An epigenetic-modifying DNA-targeting system comprising at least one DNA-targeting module for repressing transcription of a Hepatitis B viral (HBV) gene, wherein the DNA-targeting module comprises a fusion protein comprising:
   (a) a DNA-binding domain for targeting to a target site within a target region spanning within 300 base pairs upstream of the hepatitis B X protein (HBx) start codon; and
   (b) at least one transcriptional repressor effector domain.
4. The epigenetic-modifying DNA-targeting system of any of embodiments 1-3, wherein the target site is positioned in the HBx basal core promoter region.
5. The epigenetic-modifying DNA-targeting system of any of embodiments 1-3, wherein the target site is positioned within the HBx promoter/Enhancer region.
6. The epigenetic-modifying DNA-targeting system of any of embodiments 1-5, wherein the target site is within a target region spanning within 150 base pairs upstream of the hepatitis B X protein (HBx) start codon.
7. The epigenetic-modifying DNA-targeting system of any of embodiments 1-6, wherein the target site is within a target region that has a sequence corresponding to the sequence located at base pairs between 1255-1302 bp with reference to the HBV genome set forth in SEQ ID NO: 650.
8. The epigenetic-modifying DNA-targeting system of any of embodiments 1-7, wherein the target site is within a target region that has a sequence corresponding to the sequence located at base pairs between 1260-1300 bp with reference to the HBV genome set forth in SEQ ID NO: 650.
9. The epigenetic-modifying DNA-targeting system of any of embodiments 1-8, wherein the target site comprises the sequence set forth in SEQ ID NO: 22 or SEQ ID NO:63, a contiguous portion thereof of at least 14 nucleotides, or a complementary sequence of any of the foregoing.
10. The epigenetic-modifying DNA-targeting system of any of embodiments 1-9, wherein the at least one DNA-binding domain comprises a Clustered Regularly Interspaced Short Palindromic Repeats associated (Cas)-guide RNA (gRNA) combination comprising (a) a deactivated Cas (dCas) and (b) at least one gRNA.
11. The epigenetic-modifying DNA-targeting system of embodiment 10, wherein the dCas is a dCas9 protein.
12. The epigenetic-modifying DNA-targeting system of embodiment 11, wherein the dCas9 is a *Streptococcus pyogenes* dCas9 (dSpCas9) protein that comprises at least one amino acid mutation selected from D10A and H840A, with reference to numbering of positions of SEQ ID NO: 598.
13. The epigenetic-modifying DNA-targeting system of any of embodiments 10-12, wherein the gRNA comprises the sequence set forth in SEQ ID NO: 217, a contiguous portion thereof of at least 14 nucleotides, or a complementary sequence of any of the foregoing.
14. The epigenetic-modifying DNA-targeting system of any of embodiments 10-13, wherein the gRNA is set forth in SEQ ID NO: 412.
15. The epigenetic-modifying DNA-targeting system of any of embodiments 10-12, wherein the gRNA comprises the sequence set forth in SEQ ID NO: 258, a contiguous portion thereof of at least 14 nucleotides, or a complementary sequence of any of the foregoing.
16. The epigenetic-modifying DNA-targeting system of any of embodiments 10-12 and 15, wherein the gRNA is set forth in SEQ ID NO: 453.
17. The epigenetic-modifying DNA-targeting system of any of embodiments 1-9, wherein the at least one DNA-binding domain comprises an engineered zinc finger protein (eZFP).
18. The epigenetic-modifying DNA-targeting system of any of embodiments 1-9 and 17, wherein the target site comprises the nucleotide sequence set forth in any one of SEQ ID NOS: 1045, 1046, 1052, a contiguous portion thereof of at least 12 nt, or a complementary sequence of any of the foregoing.
19. The epigenetic-modifying DNA-targeting system of any of embodiments 17-18, wherein the zinc finger protein comprises six zinc fingers denoted F1 through F6 in order from N-terminus to C-terminus, and wherein the amino acid sequence of each zinc finger recognition region is as follows:

```
(A)
F1:
                                         (SEQ ID NO: 822)
QSAHRKN

F2:
                                         (SEQ ID NO: 823)
TSSNRKT

F3:
                                         (SEQ ID NO: 824)
RSDNLSA

F4:
                                         (SEQ ID NO: 825)
RNNDRKT

F5:
                                         (SEQ ID NO: 826)
TSGSLSR

F6:
                                         (SEQ ID NO: 827)
QAGHLAK;

(B)
F1:
                                         (SEQ ID NO: 828)
RSDHLSQ
```

-continued

F2:
ASSTRTK (SEQ ID NO: 829)

F3:
RSDDLTR (SEQ ID NO: 830)

F4:
QKSNLSS (SEQ ID NO: 831)

F5:
QSANRTT (SEQ ID NO: 832)

F6:
QNATRTK; (SEQ ID NO: 833)
or (C)
F1:
QSSSLVR (SEQ ID NO: 864)

F2:
QSGDLRR (SEQ ID NO: 865)

F3:
RSDERKR (SEQ ID NO: 866)

F4:
HRTTLTN (SEQ ID NO: 867)

F5:
RSDHLTN (SEQ ID NO: 868)

F6:
TSGELVR. (SEQ ID NO: 869)

20. The epigenetic-modifying DNA-targeting system of any of embodiments 17-19, wherein the eZFP comprises the sequence set forth in SEQ ID NO: 709, SEQ ID NO: 710 or SEQ ID NO:716, or an amino acid sequence that has at least 90% sequence identity thereto.
21. The epigenetic-modifying DNA-targeting system of any of embodiments 1-20, wherein at least one effector domain is a DNA methyltransferase.
22. The epigenetic modifying DNA-targeting system of any of embodiments 1-21, wherein at least one effector domain comprises a DNA methyltransferase and a repressor domain capable of recruiting heterochromatin inducing factors.
23. The epigenetic modifying DNA-targeting system of any of embodiments 1-22, wherein at least one effector domain comprises a DNA methyltransferase and a histone methyltransferase.
24. The epigenetic-modifying DNA-targeting system of any of embodiments 1-23, wherein at least one effector domain is selected from a KRAB repressor domain, ERF repressor domain, Mxil repressor domain, SID4X repressor domain, Mad-SID repressor domain. LSD1 repressor domain, or DNMT3A, DNMT3A-3L, DNMT3A/L-KRAB fusion repressor domain, DNMT3B domain binding protein or LSD1 repressor domain, or variant of any of the foregoing.
25. A polynucleotide encoding the epigenetic-modifying DNA-targeting system of any of embodiments 1-24 or a fusion protein of the DNA-targeting system of any of embodiments 1-24, or a portion or a component of any of the foregoing.
26. A vector comprising the polynucleotide of embodiment 25.

Also among the provided embodiments are:
1. An epigenetic-modifying DNA-targeting system comprising at least one DNA-targeting module for repressing transcription of one or more Hepatitis B viral (HBV) genes, wherein each of at least one DNA-targeting module comprises a fusion protein comprising:
   (a) a DNA-binding domain for targeting to a target site in a Hepatitis B viral DNA sequence; and
   (b) a transcriptional repressor effector domain comprising a KRAB domain and a DNMT3A/L domain.
2. The epigenetic-modifying DNA-targeting system of embodiment 1, wherein the KRAB domain comprises the sequence set forth in SEQ ID NO: 590, or an amino acid sequence that has at least 90% sequence identity to SEQ ID NO:590.
3. The epigenetic-modifying DNA-targeting system of embodiment 1 or 2, wherein the DNMT3A/L domain comprises the sequence set forth in SEQ ID NO: 651, or an amino acid sequence that has at least 90% sequence identity to SEQ ID NO:651.
4. An epigenetic-modifying DNA-targeting system comprising at least one DNA-targeting module for repressing transcription of one or more Hepatitis B viral (HBV) genes, wherein each of at least one DNA-targeting module comprises a fusion protein comprising:
   (a) a DNA-binding domain for targeting to a target site in a Hepatitis B viral DNA sequence; and
   (b) a transcriptional repressor effector domain comprising a KRAB domain and a DNMT3A/L domain, wherein the KRAB domain comprises the sequence set forth in SEQ ID NO: 590, or an amino acid sequence that has at least 90% sequence identity to SEQ ID NO:590 and the DNMT3A/L domain comprises the sequence set forth in SEQ ID NO: 651, or an amino acid sequence that has at least 90% sequence identity to SEQ ID NO:651.
5. The epigenetic-modifying DNA-targeting system of any of embodiments 1-4, wherein the KRAB domain and DNMT3A/L domain is independently fused to the N-terminus, the C-terminus, or both the N-terminus and the C-terminus, of the DNA-binding domain.
6. The epigenetic-modifying DNA-targeting system of any of embodiments 1-5, wherein the fusion protein further comprises one or more nuclear localization signals (NLS).
7. The epigenetic-modifying DNA-targeting system of embodiment 6, wherein the fusion protein further comprises one or more linkers connecting two or more of: the DNA-binding domain, the KRAB domain, the DNMT3A/L domain, and the one or more nuclear localization signals.
8. The epigenetic-modifying DNA-targeting system of any of embodiments 1-7, wherein the Hepatitis B viral DNA sequence is an HBV gene or a regulatory element thereof.
9. The epigenetic-modifying DNA-targeting system of any of embodiments 1-8, wherein the target site is present in a covalently closed circular DNA (cccDNA)

form, relaxed circular DNA (rcDNA) form and/or is in HBV viral DNA integrated in the human genomic DNA.

10. The epigenetic-modifying DNA-targeting system of any of embodiments 1-9, wherein the target site is present at or near a gene or a regulatory element thereof involved in controlling HBV replication and/or HBV transcription, wherein the gene is a polymerase gene, S-family gene, X-gene, or core family gene.

11. The epigenetic-modifying DNA-targeting system of any of embodiments 1-10, wherein at least one target site is in gene or regulatory element thereof of the X-gene encoding Hepatitis B Virus Protein X (HBx).

12. The epigenetic-modifying DNA-targeting system of embodiment 10, wherein the regulatory element is a promoter region.

13. The epigenetic-modifying DNA-targeting system of embodiment 12, wherein the promoter region is a pre-S1 promoter, a pre-S2 promoter, X promoter, or basal core promoter.

14. The epigenetic-modifying DNA-targeting system of embodiment 10, wherein the regulatory element is an enhancer region.

15. The epigenetic-modifying DNA-targeting system of embodiment 14, wherein the enhancer region is an Enh1 or an Enh2 enhancer region.

16. The epigenetic-modifying DNA-targeting system of any of embodiments 1-15, wherein the target site is at least 70% homologous to at least 1000 Hepatitis B viral genomes.

17. The epigenetic-modifying DNA-targeting system of any of embodiments 1-16, wherein at least one DNA-binding domain comprises a Clustered Regularly Interspaced Short Palindromic Repeats associated (Cas)-guide RNA (gRNA) combination comprising (a) a Cas protein or a variant thereof and (b) at least one gRNA; a zinc finger protein (ZFP); a transcription activator-like effector (TALE); a meganuclease; a homing endonuclease; or an I-SceI enzyme or a variant thereof.

18. The epigenetic-modifying DNA-targeting system of any of embodiments 1-18, wherein the DNA-binding domain is Cas-gRNA combination, wherein the Cas is a deactivated Cas (dCas) protein.

19. The epigenetic-modifying DNA-targeting system of embodiment 18, wherein the dCas is a deactivated Cas9 (dCas9) protein.

20. The epigenetic-modifying DNA-targeting system of embodiment 19, wherein the dCas9 is a *Staphylococcus aureus* dCas9 protein (dSaCas9) that comprises at least one amino acid mutation selected from D10A and N580A, with reference to numbering of positions of SEQ ID NO: 596.

21. The epigenetic-modifying DNA-targeting system of embodiment 19, wherein the dCas9 is a *Streptococcus pyogenes* dCas9 (dSpCas9) protein that comprises at least one amino acid mutation selected from D10A and H840A, with reference to numbering of positions of SEQ ID NO: 598.

22. An epigenetic-modifying DNA-targeting system comprising,
(a) a fusion protein comprising (i) a Clustered Regularly Interspaced Short Palindromic Repeats associated protein 9 (Cas9) that is a deactivated Cas9 (dCas9) comprising at least one amino acid mutation selected from D10A and N580A, with reference to numbering of positions of SEQ ID NO: 596 and (ii) a transcriptional repressor effector domain comprising a KRAB domain and a DNMT3A/L domain, wherein the KRAB domain comprises an amino acid sequence that has at least 90% sequence identity to SEQ ID NO:590 and the DNMT3A/L domain comprises an amino acid sequence that has at least 90% sequence identity to SEQ ID NO:651; and
(b) a gRNA for targeting to a target site in a Hepatitis B viral DNA sequence.

23. The epigenetic-modifying DNA-targeting system of embodiment 22, wherein the target site is in a gene or regulatory element thereof of the X-gene encoding Hepatitis B Virus Protein X (HBx).

24. The epigenetic-modifying DNA-targeting system of any of embodiments 1-18, wherein at least one DNA-binding domain comprises an engineered zinc finger protein (eZFP).

25. An epigenetic-modifying DNA-targeting system comprising, a fusion protein comprising (i) an engineered zinc finger protein (eZFP) for targeting to a target site in a Hepatitis B viral DNA sequence and (ii) a transcriptional repressor effector domain comprising a KRAB domain and a DNMT3A/L domain, wherein the KRAB domain comprises an amino acid sequence that has at least 90% sequence identity to SEQ ID NO:590 and the DNMT3A/L domain comprises an amino acid sequence that has at least 90% sequence identity to SEQ ID NO:651.

26. The epigenetic-modifying DNA-targeting system of embodiment 25, wherein the target site is in a gene or regulatory element thereof of the X-gene encoding Hepatitis B Virus Protein X (HBx).

27. The epigenetic-modifying DNA-targeting system of any embodiments 1-26, wherein the DNA-targeting system targets at least 70% of all Hepatitis B viral genomes.

28. A polynucleotide encoding the epigenetic-modifying DNA-targeting system of any of embodiments 1-27 or a fusion protein of the DNA-targeting system of any of embodiments 1-27, or a portion or a component of any of the foregoing.

29. A vector comprising the polynucleotide of embodiment 28.

VIII. EXAMPLES

The following examples are included for illustrative purposes only and are not intended to limit the scope of the invention.

Example 1: Design of gRNAs Targeting Hepatitis B Viral Genes and Regulatory Element Thereof Associated with Viral Replication and Transcription gRNAs were designed for targeting Hepatitis B viral (HBV) genes and regulatory element thereof associated with viral replication and transcription.

Computational analysis was used to generate a master gRNA protospacer list (target sites) from 6939 different HBV genomes (genotypes A-E). The master gRNA list contained all 110, 438 unique protospacer-PAM sequences (target sites) found across all the genomes (defined by "[N](×20)-NGG"). Next, the protospacer sequences (target sites) were aligned back to all the 6939 HBV genomes. The protospacer sequences were then organized into three categories based on homology and mismatches in the 12 bases on the 5' end of the protospacer adjacent motif (PAM), as represented by 'n' in 'nnnnnnnnnnnnNNNNNNNN-NGG':

1) protospacer present with no mismatches (HBV0), 2) protospacer present if one mismatch was allowed (HBV1), and 3) protospacer present if up to two mismatches were allowed (HBV2).

For every protospacer sequence, each of these three scores was generated. The scores represented the probability that for a given HBV genome, the protospacer would be present and active given the specific tolerances for mismatches in the 5'-end of the PAM. Multiple variants were found to be present on the same core protospacer-PAM sequence in the analysis. Therefore, the protospacer sequence list was further grouped based on the core protospacer-PAM sequence (NNNNNNNN-NGG). Finally, the protospacer sequence in each group with the highest perfect genome alignment score (homology) was chosen as the candidate gRNA for a given core protospacer-PAM sequence. The screening candidate spacers with more than 90% HBV genomic conservation and no mismatches (HBV0) are shown in Table E1. The screening candidate gRNA spacers with more than 90% HBV genomic conservation and 1-2 mismatches (HBV1) are shown in Table E1. The screening candidate gRNA spacers with 70-90% HBV genomic conservation and up to 2 mismatches (HBV2) are shown in Table E1. Each gRNA further comprised a scaffold sequence for SpCas9, comprising the sequence:

(SEQ ID NO: 587)
GUUUAAGAGCUAUGCUGGAAACAGCAUAGCAAGUUUAAAUAAGGCUAGUCCGUUAUCAA
CUUGAAAAAGUGGCACCGAGUCGGUGC.

5'-(protospacer) mN*mN*mN*rNrNrNrNrNrNrNrNrNrNrNrNrNrNrNrN rN (scaffold)

rGrUrUrUrUrArGrArGrCrUrArGrArArArUrArGrCrArArGrUrUrArArArArUrArArGrGrCUrArGrUrCr

CrGrUrUrArUrCrArArCrUrUrGrArArArArArGrUrGrGrCrArCrCrGrArGrUrCrGrGrUrGrCrU*mU*mU

*mU-3'

Where m=2' OMethyl RNA and *=Phosphorothioated bonds

TABLE E1

Candidate gRNAs with >90% HBV genomic conservation and no mismatches (HBV0)

| Target Site (protospacer) sequence | Target SEQ ID | Sequence name | gRNA spacer sequence | RNA spacer SEQ ID |
|---|---|---|---|---|
| CCCTATCTTATCAACACTTC | 1 | HBVg_1 | CCCUAUCUUAUCAACACUUC | 196 |
| GCAGAGGTGAAAAAGTTGCA | 2 | HBVg_2 | GCAGAGGUGAAAAAGUUGCA | 197 |
| TGGACTTCTCTCAATTTTCT | 3 | HBVg_3 | UGGACUUCUCUCAAUUUUCU | 198 |
| ACCCCGCCTGTAACACGAGC | 4 | HBVg_4 | ACCCCGCCUGUAACACGAGC | 199 |
| CCCGCCTGTAACACGAGCAG | 5 | HBVg_5 | CCCGCCUGUAACACGAGCAG | 200 |
| CACCACGAGTCTAGACTCTG | 6 | HBVg_6 | CACCACGAGUCUAGACUCUG | 201 |
| GAGGTGAAGCGAAGTGCACA | 7 | HBVg_7 | GAGGUGAAGCGAAGUGCACA | 202 |
| CCGGAAGTGTTGATAAGATA | 8 | HBVg_8 | CCGGAAGUGUUGAUAAGAUA | 203 |
| AGAAGATGAGGCATAGCAGC | 9 | HBVg_9 | AGAAGAUGAGGCAUAGCAGC | 204 |
| TCCGCAGTATGGATCGGCAG | 10 | HBVg_10 | UCCGCAGUAUGGAUCGGCAG | 205 |
| GGACTTCTCTCAATTTTCTA | 11 | HBVg_11 | GGACUUCUCUCAAUUUUCUA | 206 |
| CCACCCAAGGCACAGCTTGG | 12 | HBVg_12 | CCACCCAAGGCACAGCUUGG | 207 |
| AGAGAGGTGCGCCCCGTGGT | 13 | HBVg_13 | AGAGAGGUGCGCCCCGUGGU | 208 |
| GATTGAGATCTTCTGCGACG | 14 | HBVg_14 | GAUUGAGAUCUUCUGCGACG | 209 |
| CAAGCCTCCAAGCTGTGCCT | 15 | HBVg_15 | CAAGCCUCCAAGCUGUGCCU | 210 |
| GGCGAGGGAGTTCTTCTTCT | 16 | HBVg_16 | GGCGAGGGAGUUCUUCUUCU | 211 |
| TCCGGAAGTGTTGATAAGAT | 17 | HBVg_17 | UCCGGAAGUGUUGAUAAGAU | 212 |
| AAGCCACCCAAGGCACAGCT | 18 | HBVg_18 | AAGCCACCCAAGGCACAGCU | 213 |
| CCTCCAAGCTGTGCCTTGGG | 19 | HBVg_19 | CCUCCAAGCUGUGCCUUGGG | 214 |

TABLE E1-continued

Candidate gRNAs with >90% HBV genomic conservation and no mismatches (HBV0)

| Target Site (protospacer) sequence | Target SEQ ID | Sequence name | gRNA spacer sequence | RNA spacer SEQ ID |
|---|---|---|---|---|
| GTAAAGAGAGGTGCGCCCCG | 20 | HBVg_20 | GUAAAGAGAGGUGCGCCCCG | 215 |
| GGCAGATGAGAAGGCACAGA | 21 | HBVg_21 | GGCAGAUGAGAAGGCACAGA | 216 |
| AGGAGTTCCGCAGTATGGAT | 22 | HBVg_22 | AGGAGUUCCGCAGUAUGGAU | 217 |
| GCTGTGCCTTGGGTGGCTTT | 23 | HBVg_23 | GCUGUGCCUUGGGUGGCUUU | 218 |
| ACCCCTGCTCGTGTTACAGG | 24 | HBVg_24 | ACCCCUGCUCGUGUUACAGG | 219 |
| CGGAAGTGTTGATAAGATAG | 25 | HBVg_25 | CGGAAGUGUUGAUAAGAUAG | 220 |
| CCTGCTGGTGGCTCCAGTTC | 26 | HBVg_26 | CCUGCUGGUGGCUCCAGUUC | 221 |
| CGAGGGAGTTCTTCTTCTAG | 27 | HBVg_27 | CGAGGGAGUUCUUCUUCUAG | 222 |
| GGGGCGCACCTCTCTTTACG | 28 | HBVg_28 | GGGGCGCACCUCUCUUUACG | 223 |
| AGCTTGGAGGCTTGAACAGT | 29 | HBVg_29 | AGCUUGGAGGCUUGAACAGU | 224 |
| AAGCCTCCAAGCTGTGCCTT | 30 | HBVg_30 | AAGCCUCCAAGCUGUGCCUU | 225 |
| CCCCTGCTCGTGTTACAGGC | 31 | HBVg_31 | CCCCUGCUCGUGUUACAGGC | 226 |
| GCGAGGGAGTTCTTCTTCTA | 32 | HBVg_32 | GCGAGGGAGUUCUUCUUCUA | 227 |
| TACTAGTGCCATTTGTTCAG | 33 | HBVg_33 | UACUAGUGCCAUUUGUUCAG | 228 |
| GACTTCTCTCAATTTTCTAG | 34 | HBVg_34 | GACUUCUCUCAAUUUUCUAG | 229 |

TABLE E2

Candidate gRNAs with >90% HBV genomic conservation and 1-2 mismatches (HBV1)

| Target Site (protospacer) sequence | Target SEQ ID | Target sequence | gRNA spacer sequence | RNA spacer SEQ ID |
|---|---|---|---|---|
| ATTGACCCGTATAAAGAATT | 35 | HBVg_35 | AUUGACCCGUAUAAAGAAUU | 230 |
| ACCCAAAGACAAAAGAAAAT | 36 | HBVg_36 | ACCCAAAGACAAAAGAAAAU | 231 |
| GTCCTCTTATGTAAGACCTT | 37 | HBVg_37 | GUCCUCUUAUGUAAGACCUU | 232 |
| TGATCGGGAAAGAATCCCAG | 38 | HBVg_38 | UGAUCGGGAAAGAAUCCCAG | 233 |
| TTTGCTGACGCAACCCCCAC | 39 | HBVg_39 | UUUGCUGACGCAACCCCCAC | 234 |
| ATGAATCTAGCCACCTGGGT | 40 | HBVg_40 | AUGAAUCUAGCCACCUGGGU | 235 |
| GGTCTCCATGCGACGTGCAG | 41 | HBVg_41 | GGUCUCCAUGCGACGUGCAG | 236 |
| GGACTGAGGCCCACTCCCAT | 42 | HBVg_42 | GGACUGAGGCCCACUCCCAU | 237 |
| CACAGAGTCTAGACTCGTGG | 43 | HBVg_43 | CACAGAGUCUAGACUCGUGG | 238 |
| GAAGAACCAACAAGAAGATG | 44 | HBVg_44 | GAAGAACCAACAAGAAGAUG | 239 |
| ACACGGTCCGGCAGATGAGA | 45 | HBVg_45 | ACACGGUCCGGCAGAUGAGA | 240 |

TABLE E2-continued

Candidate gRNAs with >90% HBV genomic conservation and 1-2 mismatches (HBV1)

| Target Site (protospacer) sequence | Target SEQ ID | Target sequence | gRNA spacer sequence | RNA spacer SEQ ID |
|---|---|---|---|---|
| GACATGAACATGAGATGATT | 46 | HBVg_46 | GACAUGAACAUGAGAUGAUU | 241 |
| GCAGCACAGCCTAGCAGCCA | 47 | HBVg_47 | GCAGCACAGCCUAGCAGCCA | 242 |
| TCCTGGAATTAGAGGACAAA | 48 | HBVg_48 | UCCUGGAAUUAGAGGACAAA | 243 |
| GTCTTACATAAGAGGACTCT | 49 | HBVg_49 | GUCUUACAUAAGAGGACUCU | 244 |
| TTGTGGGTCACCATATTCTT | 50 | HBVg_50 | UUGUGGGUCACCAUAUUCUU | 245 |
| CGCAAAATACCTATGGGAGT | 51 | HBVg_51 | CGCAAAAUACCUAUGGGAGU | 246 |
| GGGTTGCGTCAGCAAACACT | 52 | HBVg_52 | GGGUUGCGUCAGCAAACACU | 247 |
| AGCTCTTGTTCCCAAGAATA | 53 | HBVg_53 | AGCUCUUGUUCCCAAGAAUA | 248 |
| TGACATACTTTCCAATCAAT | 54 | HBVg_54 | UGACAUACUUUCCAAUCAAU | 249 |
| CAGATGAGAAGGCACAGACG | 55 | HBVg_55 | CAGAUGAGAAGGCACAGACG | 250 |
| CCCCGCCTGTAACACGAGCA | 56 | HBVg_56 | CCCCGCCUGUAACACGAGCA | 251 |
| GGGTGGAGCCCTCAGGCTCA | 57 | HBVg_57 | GGGUGGAGCCCUCAGGCUCA | 252 |
| ATTCCTTGGACTCATAAGGT | 58 | HBVg_58 | AUUCCUUGGACUCAUAAGGU | 253 |
| TTTGTGGGTCACCATATTCT | 59 | HBVg_59 | UUUGUGGGUCACCAUAUUCU | 254 |
| GTGAAAAGTTGCATGGTGC | 60 | HBVg_60 | GUGAAAAGUUGCAUGGUGC | 255 |
| CCTGAACTGGAGCCACCAGC | 61 | HBVg_61 | CCUGAACUGGAGCCACCAGC | 256 |
| TCCTCTGCCGATCCATACTG | 62 | HBVg_62 | UCCUCUGCCGAUCCAUACUG | 257 |
| CGGCTAGGAGTTCCGCAGTA | 63 | HBVg_63 | CGGCUAGGAGUUCCGCAGUA | 258 |
| AATGTCAACGACCGACCTTG | 64 | HBVg_64 | AAUGUCAACGACCGACCUUG | 259 |
| GACCTTCGTCTGCGAGGCGA | 65 | HBVg_65 | GACCUUCGUCUGCGAGGCGA | 260 |
| GTTGCCGGGCAACGGGGTAA | 66 | HBVg_66 | GUUGCCGGGCAACGGGGUAA | 261 |
| GATTGAGACCTTCGTCTGCG | 67 | HBVg_67 | GAUUGAGACCUUCGUCUGCG | 262 |
| AGGACCCCTGCTCGTGTTAC | 68 | HBVg_68 | AGGACCCCUGCUCGUGUUAC | 263 |
| TTTGAAGTATGCCTCAAGGT | 69 | HBVg_69 | UUUGAAGUAUGCCUCAAGGU | 264 |

TABLE E2-continued

Candidate gRNAs with >90% HBV genomic conservation and 1-2 mismatches (HBV1)

| Target Site (protospacer) sequence | Target SEQ ID | Target sequence | gRNA spacer sequence | RNA spacer SEQ ID |
|---|---|---|---|---|
| CCGCTTGTTTTGCTCGCAGC | 70 | HBVg_70 | CCGCUUGUUUUGCUCGCAGC | 265 |
| TGCTAGGCTGTGCTGCCAAC | 71 | HBVg_71 | UGCUAGGCUGUGCUGCCAAC | 266 |
| TGCCGATTGGTGGAGGCAGG | 72 | HBVg_72 | UGCCGAUUGGUGGAGGCAGG | 267 |
| TCTTTGTACTAGGAGGCTGT | 73 | HBVg_73 | UCUUUGUACUAGGAGGCUGU | 268 |
| CGTCCCGCGCAGGATCCAGT | 74 | HBVg_74 | CGUCCCGCGCAGGAUCCAGU | 269 |
| AAAGCCCAAGATGATGGGAT | 75 | HBVg_75 | AAAGCCCAAGAUGAUGGGAU | 270 |
| GCAGATGAGAAGGCACAGAC | 76 | HBVg_76 | GCAGAUGAGAAGGCACAGAC | 271 |
| CGATTGGTGGAGGCAGGAGG | 77 | HBVg_77 | CGAUUGGUGGAGGCAGGAGG | 272 |
| AGGAGGCTGTAGGCATAAAT | 78 | HBVg_78 | AGGAGGCUGUAGGCAUAAAU | 273 |
| CCATGCCCCAAAGCCACCCA | 79 | HBVg_79 | CCAUGCCCCAAAGCCACCCA | 274 |
| AGGTTGGGGACTGCGAATTT | 80 | HBVg_80 | AGGUUGGGGACUGCGAAUUU | 275 |
| AGACCTTCGTCTGCGAGGCG | 81 | HBVg_81 | AGACCUUCGUCUGCGAGGCG | 276 |
| CCTGGAATTAGAGGACAAAC | 82 | HBVg_82 | CCUGGAAUUAGAGGACAAAC | 277 |
| TTTCAGTTATATGGATGATG | 83 | HBVg_83 | UUUCAGUUAUAUGGAUGAUG | 278 |
| GTAACACGAGCAGGGTCCT | 84 | HBVg_84 | GUAACACGAGCAGGGGUCCU | 279 |
| CATCTTCTTGTTGGTTCTTC | 85 | HBVg_85 | CAUCUUCUUGUUGGUUCUUC | 280 |
| CGGGGAGACCGCGTAAAGAG | 86 | HBVg_86 | CGGGGAGACCGCGUAAAGAG | 281 |
| CTAGACTCTGTGGTATTGTG | 87 | HBVg_87 | CUAGACUCUGUGGUAUUGUG | 282 |
| CCCTGCTCGTGTTACAGGCG | 88 | HBVg_88 | CCCUGCUCGUGUUACAGGCG | 283 |
| TACCACAGAGTCTAGACTCG | 89 | HBVg_89 | UACCACAGAGUCUAGACUCG | 284 |
| TCGCAAAATACCTATGGGAG | 90 | HBVg_90 | UCGCAAAAUACCUAUGGGAG | 285 |
| GTCTGTGCCTTCTCATCTGC | 91 | HBVg_91 | GUCUGUGCCUUCUCAUCUGC | 286 |
| ACACGTAGCGCCTCATTTTG | 92 | HBVg_92 | ACACGUAGCGCCUCAUUUUG | 287 |
| TTGGGGTTGAGGTCCCAATC | 93 | HBVg_93 | UUGGGGUUGAGGUCCCAAUC | 288 |

TABLE E2-continued

Candidate gRNAs with >90% HBV genomic conservation and 1-2 mismatches (HBV1)

| Target Site (protospacer) sequence | Target SEQ ID | Target sequence | gRNA spacer sequence | RNA spacer SEQ ID |
|---|---|---|---|---|
| CCCCGAGACGGGTCGTCCGC | 94 | HBVg_94 | CCCCGAGACGGGUCGUCCGC | 289 |
| CCTACGAACCACTGAACAAA | 95 | HBVg_95 | CCUACGAACCACUGAACAAA | 290 |
| TTACATACTCTGTGGAAGGC | 96 | HBVg_96 | UUACAUACUCUGUGGAAGGC | 291 |
| ACCTCCTTTCCATGGCTGCT | 97 | HBVg_97 | ACCUCCUUUCCAUGGCUGCU | 292 |
| GTTATCGCTGGATGTGTCTG | 98 | HBVg_98 | GUUAUCGCUGGAUGUGUCUG | 293 |
| AACATGAGATGATTAGGCAG | 99 | HBVg_99 | AACAUGAGAUGAUUAGGCAG | 294 |
| ACTTCTCTCAATTTTCTAGG | 100 | HBVg_100 | ACUUCUCUCAAUUUUCUAGG | 295 |

TABLE E3

Candidate gRNAs with 70-90% HBV genomic conservation and up to 2 mismatches (HBV2)

| Target Site (protospacer) sequence | Target SEQ ID | Sequence name | gRNA spacer sequence | RNA spacer SEQ ID |
|---|---|---|---|---|
| CACTTTCTCGCCAACTTACA | 101 | HBVg_101 | CACUUUCUCGCCAACUUACA | 296 |
| CATAAGGTGGGAAACTTTAC | 102 | HBVg_102 | CAUAAGGUGGGAAACUUUAC | 297 |
| CCAAACCTCGAAAAGGCATG | 103 | HBVg_103 | CCAAACCUCGAAAAGGCAUG | 298 |
| ATAGAAGGAAAGAAGTCAGA | 104 | HBVg_104 | AUAGAAGGAAAGAAGUCAGA | 299 |
| GCTGCTCCTTTTACACAATG | 105 | HBVg_105 | GCUGCUCCUUUUACACAAUG | 300 |
| GAAGCGAAGTGCACACGGTC | 106 | HBVg_106 | GAAGCGAAGUGCACACGGUC | 301 |
| GGATCATCAACCACCAGCAC | 107 | HBVg_107 | GGAUCAUCAACCACCAGCAC | 302 |
| GAGCCAAGAGAAACGGACTG | 108 | HBVg_108 | GAGCCAAGAGAAACGGACUG | 303 |
| CTTCACCTCTGCACGTCGCA | 109 | HBVg_109 | CUUCACCUCUGCACGUCGCA | 304 |
| ACAATGTTCCGGAGACTCTA | 110 | HBVg_110 | ACAAUGUUCCGGAGACUCUA | 305 |
| TCCGCGGGATTCAGCGCCGA | 111 | HBVg_111 | UCCGCGGGAUUCAGCGCCGA | 306 |
| TTAATGAGTGGGAGGAGTTG | 112 | HBVg_112 | UUAAUGAGUGGGAGGAGUUG | 307 |
| CCAACTCAAACAATCCAGAT | 113 | HBVg_113 | CCAACUCAAACAAUCCAGAU | 308 |

TABLE E3-continued

Candidate gRNAs with 70-90% HBV genomic conservation and up to 2 mismatches (HBV2)

| Target Site (protospacer) sequence | Target SEQ ID | Sequence name | gRNA spacer sequence | RNA spacer SEQ ID |
|---|---|---|---|---|
| GCTGCCAACTGGATCCTGCG | 114 | HBVg_114 | GCUGCCAACUGGAUCCUGCG | 309 |
| AGTCTTTGAAGTATGCCTCA | 115 | HBVg_115 | AGUCUUUGAAGUAUGCCUCA | 310 |
| TCCTGACTGCCGATTGGTGG | 116 | HBVg_116 | UCCUGACUGCCGAUUGGUGG | 311 |
| TCTTGTCCTCCAATTTGTCC | 117 | HBVg_117 | UCUUGUCCUCCAAUUUGUCC | 312 |
| CGATAACCAGGACAAATTGG | 118 | HBVg_118 | CGAUAACCAGGACAAAUUGG | 313 |
| ATTTGGAAGATCCAGCATCC | 119 | HBVg_119 | AUUUGGAAGAUCCAGCAUCC | 314 |
| CTGTTTGGCTTTCAGTTATA | 120 | HBVg_120 | CUGUUUGGCUUUCAGUUAUA | 315 |
| CTCCTCCTGCCTCCACCAAT | 121 | HBVg_121 | CUCCUCCUGCCUCCACCAAU | 316 |
| GTCATCCTCAGGCCATGCAG | 122 | HBVg_122 | GUCAUCCUCAGGCCAUGCAG | 317 |
| CTGCCGTTCCGGCCGACCAC | 123 | HBVg_123 | CUGCCGUUCCGGCCGACCAC | 318 |
| CCTTCCTGACTGCCGATTGG | 124 | HBVg_124 | CCUUCCUGACUGCCGAUUGG | 319 |
| ACCTGCACGACTCCTGCTCA | 125 | HBVg_125 | ACCUGCACGACUCCUGCUCA | 320 |
| GGCCTGTATTTTCCTGCTGG | 126 | HBVg_126 | GGCCUGUAUUUUCCUGCUGG | 321 |
| AACATAGAGGTTCCTTGAGC | 127 | HBVg_127 | AACAUAGAGGUUCCUUGAGC | 322 |
| TGCCGTTCCGGCCGACCACG | 128 | HBVg_128 | UGCCGUUCCGGCCGACCACG | 323 |
| ATAGGCCATCAGCGCATGCG | 129 | HBVg_129 | AUAGGCCAUCAGCGCAUGCG | 324 |
| GCCTCCACCAATCGGCAGTC | 130 | HBVg_130 | GCCUCCACCAAUCGGCAGUC | 325 |
| GTCCTTTGTTTACGTCCCGT | 131 | HBVg_131 | GUCCUUUGUUUACGUCCCGU | 326 |
| TGGGAACAAGAGCTACAGCA | 132 | HBVg_132 | UGGGAACAAGAGCUACAGCA | 327 |
| CTGTAAACAGGCCTATTGAT | 133 | HBVg_133 | CUGUAAACAGGCCUAUUGAU | 328 |
| GTCGCAGAAGATCTCAATCT | 134 | HBVg_134 | GUCGCAGAAGAUCUCAAUCU | 329 |
| CTGCCTTCCTGACTGCCGAT | 135 | HBVg_135 | CUGCCUUCCUGACUGCCGAU | 330 |
| ACTACTAATTCCCTGGATGC | 136 | HBVg_136 | ACUACUAAUUCCCUGGAUGC | 331 |
| CACATTTCTTGCCTTACTTT | 137 | HBVg_137 | CACAUUUCUUGCCUUACUUU | 332 |

TABLE E3-continued

Candidate gRNAs with 70-90% HBV genomic conservation and up to 2 mismatches (HBV2)

| Target Site (protospacer) sequence | Target SEQ ID | Sequence name | gRNA spacer sequence | RNA spacer SEQ ID |
|---|---|---|---|---|
| GGATGACTGTCTCTTAGAGG | 138 | HBVg_138 | GGAUGACUGUCUCUUAGAGG | 333 |
| GCTATGCCTCATCTTCTTGT | 139 | HBVg_139 | GCUAUGCCUCAUCUUCUUGU | 334 |
| CCCGTCGGCGCTGAATCCCG | 140 | HBVg_140 | CCCGUCGGCGCUGAAUCCCG | 335 |
| TAGTATTCCTTGGACTCATA | 141 | HBVg_141 | UAGUAUUCCUUGGACUCAUA | 336 |
| AGGTAGGAGCGGGAGCATTC | 142 | HBVg_142 | AGGUAGGAGCGGGAGCAUUC | 337 |
| TCTTTTGGGGTGGAGCCCTC | 143 | HBVg_143 | UCUUUUGGGGUGGAGCCCUC | 338 |
| TCAGTATGCCCTGAGCCTGA | 144 | HBVg_144 | UCAGUAUGCCCUGAGCCUGA | 339 |
| TTTAATGAGTGGGAGGAGTT | 145 | HBVg_145 | UUUAAUGAGUGGGAGGAGUU | 340 |
| CTCCCTCGCCTCGCAGACGA | 146 | HBVg_146 | CUCCCUCGCCUCGCAGACGA | 341 |
| GATAAGATAGGGGCATTTGG | 147 | HBVg_147 | GAUAAGAUAGGGGCAUUUGG | 342 |
| CCGCGGGATTCAGCGCCGAC | 148 | HBVg_148 | CCGCGGGAUUCAGCGCCGAC | 343 |
| CAGCGATAACCAGGACAAAT | 149 | HBVg_149 | CAGCGAUAACCAGGACAAAU | 344 |
| CAGGTAGGAGTGGGAGCATT | 150 | HBVg_150 | CAGGUAGGAGUGGGAGCAUU | 345 |
| GTTTAATGAGTGGGAGGAGT | 151 | HBVg_151 | GUUUAAUGAGUGGGAGGAGU | 346 |
| TGGTGAGTGATTGGAGGTTG | 152 | HBVg_152 | UGGUGAGUGAUUGGAGGUUG | 347 |
| TAATGAGTGGGAGGAGTTGG | 153 | HBVg_153 | UAAUGAGUGGGAGGAGUUGG | 348 |
| ACTACATGTTCTGGATAATA | 154 | HBVg_154 | ACUACAUGUUCUGGAUAAUA | 349 |
| GGCATAGCAGCAGGATGAAG | 155 | HBVg_155 | GGCAUAGCAGCAGGAUGAAG | 350 |
| GTTGATAAGATAGGGGCATT | 156 | HBVg_156 | GUUGAUAAGAUAGGGGCAUU | 351 |
| TCAACGAATTGTGGGTCTTT | 157 | HBVg_157 | UCAACGAAUUGUGGGUCUUU | 352 |
| TATGGATGATGTGGTATTGG | 158 | HBVg_158 | UAUGGAUGAUGUGGUAUUGG | 353 |
| CAACGAATTGTGGGTCTTTT | 159 | HBVg_159 | CAACGAAUUGUGGGUCUUUU | 354 |
| CATTTGTTCAGTGGTTCGTA | 160 | HBVg_160 | CAUUUGUUCAGUGGUUCGUA | 355 |
| CGTCTAACAACAGTAGTTTC | 161 | HBVg_161 | CGUCUAACAACAGUAGUUUC | 356 |

TABLE E3-continued

Candidate gRNAs with 70-90% HBV genomic conservation and up to 2 mismatches (HBV2)

| Target Site (protospacer) sequence | Target SEQ ID | Sequence name | gRNA spacer sequence | RNA spacer SEQ ID |
|---|---|---|---|---|
| TGCCTGAGTGCTGTATGGTG | 162 | HBVg_162 | UGCCUGAGUGCUGUAUGGUG | 357 |
| GCCCCGAGACGGGTCGTCCG | 163 | HBVg_163 | GCCCCGAGACGGGUCGUCCG | 358 |
| GACTGCCGATTGGTGGAGGC | 164 | HBVg_164 | GACUGCCGAUUGGUGGAGGC | 359 |
| TATATGGATGATGTGGTATT | 165 | HBVg_165 | UAUAUGGAUGAUGUGGUAUU | 360 |
| CTTGAGTATTTGGTGTCTTT | 166 | HBVg_166 | CUUGAGUAUUUGGUGUCUUU | 361 |
| GATCTGGTGGGCGTTCACGG | 167 | HBVg_167 | GAUCUGGUGGGCGUUCACGG | 362 |
| AGACTGGGAGGAGTTGGGGG | 168 | HBVg_168 | AGACUGGGAGGAGUUGGGGG | 363 |
| AGTCCTCTTATGTAAGACCT | 169 | HBVg_169 | AGUCCUCUUAUGUAAGACCU | 364 |
| CTCAAGATGTTGTACAGACT | 170 | HBVg_170 | CUCAAGAUGUUGUACAGACU | 365 |
| GGGAACAAGAGCTACAGCAT | 171 | HBVg_171 | GGGAACAAGAGCUACAGCAU | 366 |
| TCGCAGAAGATCTCAATCTC | 172 | HBVg_172 | UCGCAGAAGAUCUCAAUCUC | 367 |
| GGGGTGGAGCCCTCAGGCTC | 173 | HBVg_173 | GGGGUGGAGCCCUCAGGCUC | 368 |
| TATTCCTTGGACTCATAAGG | 174 | HBVg 174 | UAUUCCUUGGACUCAUAAGG | 369 |
| TCTAAGAGACAGTCATCCTC | 175 | HBVg_175 | UCUAAGAGACAGUCAUCCUC | 370 |
| CAACTCAAACAATCCAGATT | 176 | HBVg_176 | CAACUCAAACAAUCCAGAUU | 371 |
| AAACAAGGACGTCCCGCGC | 177 | HBVg_177 | AAACAAGGACGUCCCGCGC | 372 |
| CTGCCAACTGGATCCTGCGC | 178 | HBVg_178 | CUGCCAACUGGAUCCUGCGC | 373 |
| GAAGCTCCAAATTCTTTATA | 179 | HBVg 179 | GAAGCUCCAAAUUCUUUAUA | 374 |
| GTCAGTATGCCCTGAGCCTG | 180 | HBVg_180 | GUCAGUAUGCCCUGAGCCUG | 375 |
| TTTCCCACCTTATGAGTCCA | 181 | HBVg_181 | UUUCCCACCUUAUGAGUCCA | 376 |
| ACAAGAGGTTGGTGAGTGAT | 182 | HBVg_182 | ACAAGAGGUUGGUGAGUGAU | 377 |
| GAAAGCCCAAGATGATGGGA | 183 | HBVg 183 | GAAAGCCCAAGAUGAUGGGA | 378 |
| AGGTTCCACGCATGCGCTGA | 184 | HBVg_184 | AGGUUCCACGCAUGCGCUGA | 379 |
| TTGGTGAGTGATTGGAGGTT | 185 | HBVg_185 | UUGGUGAGUGAUUGGAGGUU | 380 |

TABLE E3-continued

Candidate gRNAs with 70-90% HBV genomic conservation and up to 2 mismatches (HBV2)

| Target Site (protospacer) sequence | Target SEQ ID | Sequence name | gRNA spacer sequence | RNA spacer SEQ ID |
|---|---|---|---|---|
| AGAGCTACAGCATGGGAGGT | 186 | HBVg_186 | AGAGCUACAGCAUGGGAGGU | 381 |
| ATATGGATGATGTGGTATTG | 187 | HBVg_187 | AUAUGGAUGAUGUGGUAUUG | 382 |
| CCATTTGTTCAGTGGTTCGT | 188 | HBVg_188 | CCAUUUGUUCAGUGGUUCGU | 383 |
| TTATATGGATGATGTGGTAT | 189 | HBVg_189 | UUAUAUGGAUGAUGUGGUAU | 384 |
| GGAGTGGGAGCATTCGGGCC | 190 | HBVg_190 | GGAGUGGGAGCAUUCGGGCC | 385 |
| ATTTGGTGTCTTTTGGAGTG | 191 | HBVg_191 | AUUUGGUGUCUUUUGGAGUG | 386 |
| CACAGAAAGGCCTTGTAAGT | 192 | HBVg_192 | CACAGAAAGGCCUUGUAAGU | 387 |
| ACCAATTTTCTTTTGTCTTT | 193 | HBVg_193 | ACCAAUUUUCUUUUGUCUUU | 388 |
| AGGTTAATGGTCTTTGTACT | 194 | HBVg_194 | AGGUUAAUGGUCUUUGUACU | 389 |
| TACCAATTTTCTTTTGTCTT | 195 | HBVg_195 | UACCAAUUUUCUUUUGUCUU | 390 |

Figure 4:
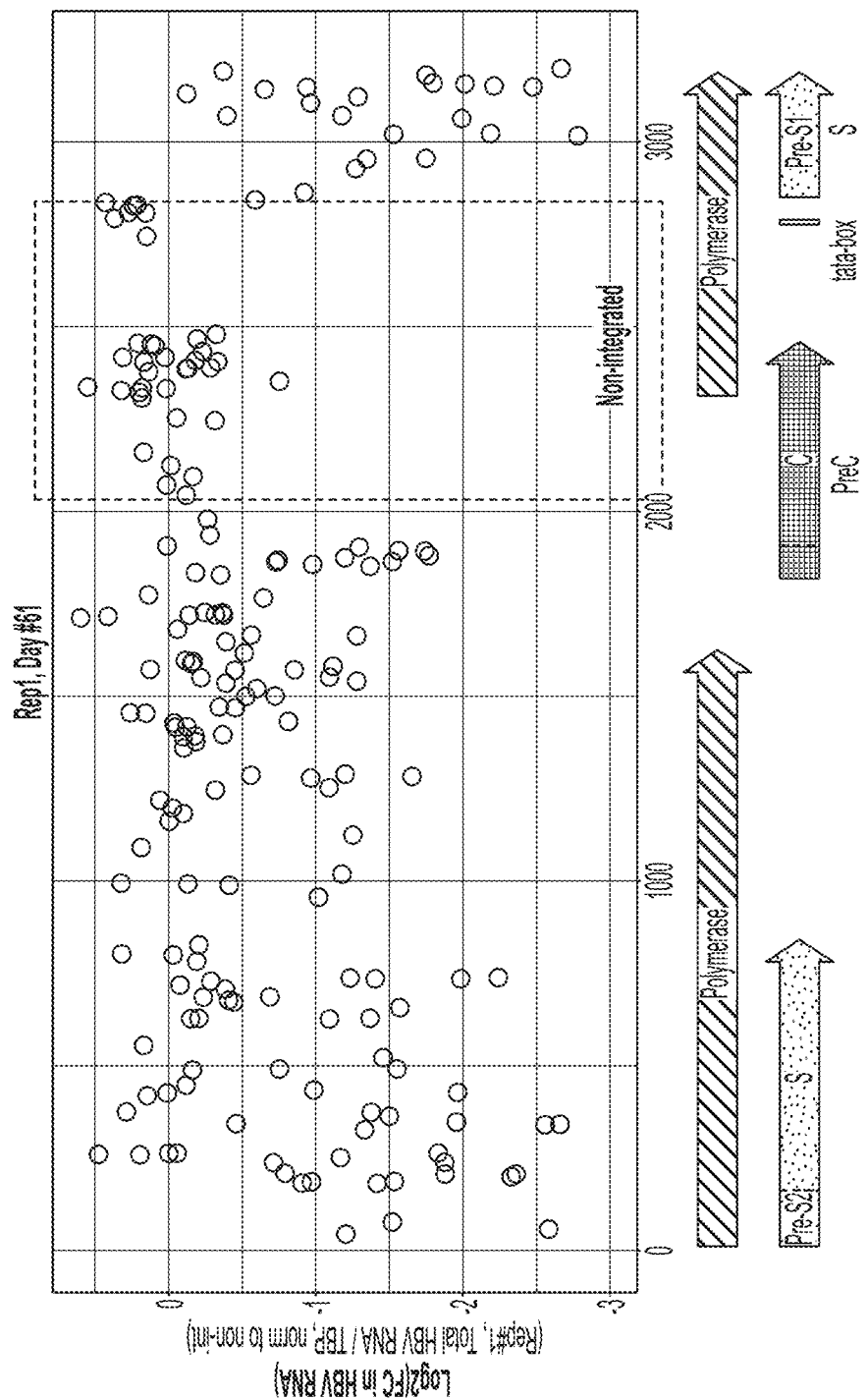
FIG. 4 depicts the fold change in total HBV RNA mediated by each guide RNA and a DNMT3A/L-dCas9-KRAB-effector fusion protein. The fold change is depicted in relation to the median targeting position of each gRNA across the HBV genome.

Example 2: Identification of gRNAs for Targeted Transcriptional Repression of Genes and Regulatory Elements Thereof Associated with Viral Replication and Transcription gRNAs were identified that facilitate transcriptional repression of targeted genes within the HBV genome present in either integrated HBV DNA and in covalently closed circular DNA (cccDNA) or relaxed circular DNA (rcDNA), as part of a DNA-targeting system comprising the gRNA and a dCas9-effector fusion protein. FIGS. 1 and 4 depict the median targeting positions of each gRNAs across the HBV genome.

I) Tranasiei Arrayedscreeningfor Modalaors of the integrated HBV genome
A. Short Interval (5-Day) Screen Using dCas9-KRAB Guide RNAs targeting genes and regulatory elements thereof associated with HBV transcription, including those listed in Tables E1-E3 and Table 6, were transfected into Hep3B cells expressing HBV from integrated sequences only (without cccDNA), together with an mRNA encoding a dSpCas9-KRAB fusion protein (SEQ ID NO:594) for transcriptional repression of gRNA-targeted genes.

Other cell lines such as immortalized HBV infected human hepatocyte cell lines (Hep3B, PLC/PRF/5), engineered hepatocyte cell lines that contain a transgene copy of the HBV genome (HepG2.2.15, HepAD38), or engineered immortalized hepatocyte lines that overexpress the cognate surface receptor required for HBV entry (HepG2.NTCP) may be considered, together with a dSpCas9-effector fusion protein for simultaneous transcriptional repression of one or more gRNA-targeted genes. Additionally, to increase repression of HBV replication and transcription a combination of multiple exemplary gRNAs from Tables E1-E3 and Table 6, either targeting the same or different HBV viral genes may be delivered in a multiplexed approach.

Transfected cells were assessed on day 5 for transcriptional repression of the targeted HBV transcripts by qRT-PCR measurement of either HBsAg transcript or total HBV RNA transcript levels (FIGS. 1 and 3). Transfected cells may also be assessed for transcriptional repression by ELISA for reduction in Hepatitis B Surface Antigen (HBsAg) levels from integrated and cccDNA as well as Hepatitis B Virus core related-Antigen Protein (HBcrAg) levels from cccDNA only. gRNAs mediating repression resulting in reduction of HBsAg by 90% and HBeAg by 50% may be identified for further analysis.

FIG. 1 depicts the log fold change in HBV RNA for each gRNA in Hep3B cells following delivery alongside dCas9-KRAB. The x-axis depicts the median targeting positions of each gRNAs across the HBV genome. As shown in FIG. 1, sites targeted by 94 out of 192 gRNAs ("Any repression", depicted using arrow) showed repression of total HBV RNA. The "hit" gRNAs identified targeted the polymerase, S, short X, or the pre-core genes. Sites targeted by 48 out of the 192 gRNAs (">75% repression", depicted using arrow) showed more than 75% repression of total HBV RNA. Guide RNAs set forth in SEQ ID NOS: 565 (HBVg_175), 528 (HBVg_138), 582 (HBVg_192), 542 (HBVg_152), 508 (HBVg_118), 515 (HBVg_125), 575 (HBVg_185), 453 (HBVg_63), 506 (HBVg_116), 514 (HBVg_124), 395 (HBVg_5), 472 (HBVg_82), 451 (HBVg_61), 488 (HBVg_98), 540 (HBVg_150), 533 (HBVg_143), 572 (HBVg_182), 566 (HBVg_176), 489 (HBVg_99), 469 (HBVg_79), 408 (HBVg_18), 465 (HBVg_75), 402 (HBVg_12), 474 (HBVg_84), 525 (HBVg_135), 416 (HBVg_26), 369 (HBVg_6), 554 (HBVg_164), 419 (HBVg_29), 545 (HBVg_155), 446 (HBVg_56), 580

(HBVg_190), 555 (HBVg_165), 412 (HBVg_22), 428 (HBVg_38), 458 (HBVg_68), 548 (HBVg_158), 511 (HBVg_121), 432 (HBVg_42), 441 (HBVg_51), 433 (HBVg_43), 579 (HBVg_189), 479 (HBVg_89), 478 (HBVg_88), 520 (HBVg_130), 462 (HBVg_72), 523 (HBVg_133), and 503 (HBVg_113) mediated more than 75% repression of total HBV RNA. Furthermore, sites targeted by 10 out of the 192 gRNAs (">90% repression", depicted using arrow) showed more than 90% repression of total HBV RNA (up to 98.5%).

Specifically, more than 90% repression of total HBV RNA was observed with gRNAs targeting the M/S-HBs promoter, Enh1/X-promoter, Enh2/Basal core promoter, L-HBs promoter or the M/S-gene promoter regions. Guide RNAs set forth in SEQ ID NOs: 565, 528, 582, 542, 508, 515, 575, 453, 506, 514, 425, or 472 mediated more than 90% repression of total HBV RNA.

Figure 3B:
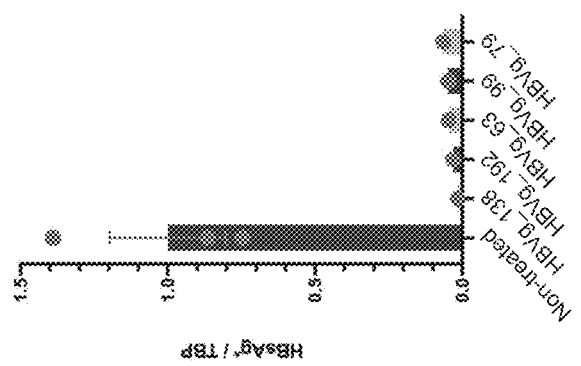
FIG. 3A-FIG. 3B depicts repression of total HBV RNA (FIG. 3A) and HBsAg (FIG. 3B) mediated by the top gRNA candidates (HBVg_192 (SEQ ID NO: 582), HBVg_17 (SEQ ID NO: 407), HBVg_63 (SEQ ID NO: 453)) from the screen at day 5 post transfection.
Figure 3A:
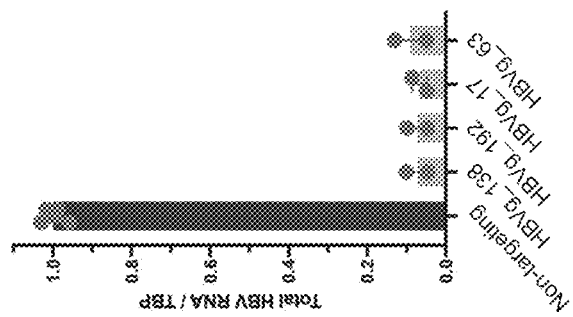

The gRNAs (SEQ ID NOS: 528 (HBVg_138), 582 (HBVg_192), 565 (HBVg_175), 453 (HBVg_63) with the highest transcriptional repression of total HBV RNA targeted the L-HBs promoter and Enh1/X-promoter regions (HBV median positions: 3197 bp (HBVg_138), 1124 bp (HBVg_192), 3179 bp (HBVg_175), and 1288 bp (HBVg_63) of the HBV genome corresponding to positions with reference to the Hepatitis B Virus genome (Hepatitis B virus subtype ayw, complete genome, GenBank: U95551.1), SEQ ID NO: 650) (FIG. 3A). The median position comprises the average position across all HBV genotypes. For instance, the median position comprises the average position of HBV genomes comprising sequences set forth in SEQ ID NOS: 650, 678, and 679. The gRNAs (SEQ ID NOS: 528 (HBVg_138), 582 (HBVg_192), 453 (HBVg_63), and 489 (HBVg_99) with the highest transcriptional repression of HBsAg RNA targeted the Enh1/X-promoter, Enh2/basal core promoter, and L-HBs promoter regions (HBV median positions: 3197 bp (HBVg_138), 1124 bp (HBVg_192), 1288 bp (HBVg_63,), 1850 bp (HBVg_99), and 1904 bp (HBVg_79), of the HBV genome corresponding to positions with reference to the Hepatitis B Virus genome (Hepatitis B virus subtype ayw, complete genome, GenBank: U95551.1), SEQ ID NO: 650) (FIG. 3B).

B. Long Interval Therapeutically Relevant Screen Using DNMT3A/L-dSpCas9-KRAB

Guide RNAs targeting genes and regulatory elements thereof associated with HBV transcription, including those listed in Tables E1-3 and Table 6, were transfected into Hep3B cells expressing HBV from integrated sequences only (without cccDNA), together with an mRNA encoding a DNMT3A/L-dSpCas9-KRAB fusion protein (SEQ ID NO: 644) for transcriptional repression of gRNA-targeted genes.

Other cell lines such as immortalized HBV infected human hepatocyte cell lines (Hep3B, PLC/PRF/5), engineered hepatocyte cell lines that contain a transgene copy of the HBV genome (HepG2.2.15, HepAD38), or engineered immortalized hepatocyte lines that overexpress the cognate surface receptor required for HBV entry (HepG2.NTCP) may be considered, together with an mRNA encoding the dSpCas9-effector fusion protein for simultaneous transcriptional repression of one or more gRNA-targeted genes. Additionally, to increase repression of HBV replication and transcription a combination of multiple exemplary gRNAs from Table E1 and Table 6, either targeting the same or different HBV viral genes may be delivered in a multiplexed approach.

Figure 5:
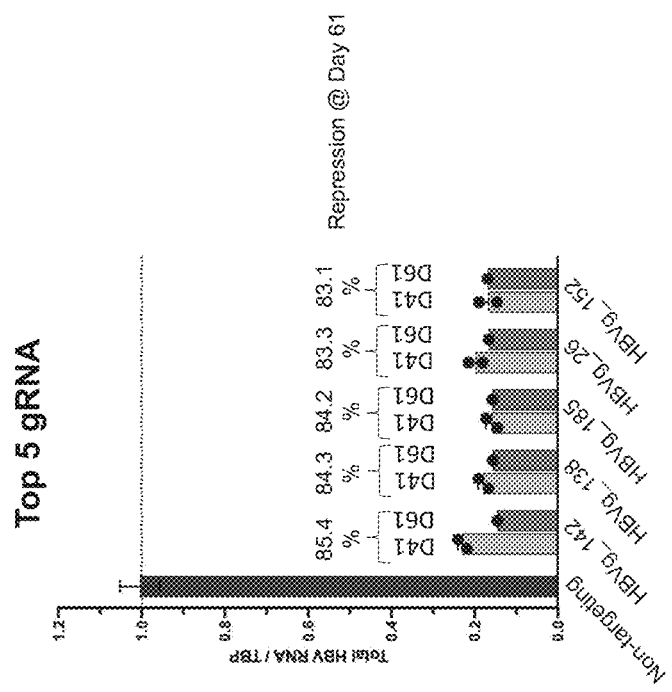
FIG. 5 depicts repression of total HBV RNA mediated by the top gRNA candidates (HBVg_142 (SEQ ID NO: 532), HBVg_138 (SEQ ID NO: 528), HBVg_185 (SEQ ID NO: 575), HBVg_152 (SEQ ID NO: 542)) from the screen at days 41 and 61 post transfection.

Transfected cells were assessed on days 41 and 61 for transcriptional repression of the targeted HBV transcripts by qRT-PCR measurement of total HBV RNA transcript levels (FIGS. 4 and 5). Transfected cells may also be assessed for transcriptional repression by ELISA for reduction in Hepatitis B Surface Antigen (HBsAg) levels from integrated and cccDNA as well as Hepatitis B Virus core related-Antigen Protein (HBcrAg) levels from cccDNA only. gRNAs mediating repression resulting in reduction of total HBV RNA transcript levels by at least 80% were identified for further analysis.

FIG. 4 depicts the log fold change in HBV RNA for each gRNA on day 61. The x-axis depicts the median targeting positions of each gRNAs across the HBV genome. The gRNAs identified targeted the polymerase, S, short X, or the pre-core genes. Specifically, more than 80% repression of total HBV RNA was observed with gRNAs targeting the pre-S1 promoter, pre-S2 promoter, and the polymerase gene.

The gRNAs (HBVg_142; SEQ ID NO: 532, HBVg_138; SEQ ID NO: 528, HBVg_185: SEQ ID NO: 575, HBVg_26: SEQ ID NO: 416, and HBVg_152; SEQ ID NO: 542) with the highest transcriptional repression of total HBV RNA targeted the pre-S1 promoter, pre-S2 promoter, CpG island 1, and the polymerase genes (Median positions: 3016 bp (HBVg_142), 3197 bp (HBVg_138), 341 bp (HBVg_185), 55 bp (HBVg_26), and 340 bp (HBVg_152) of the HBV genome corresponding to positions with reference to the Hepatitis B Virus genome (Hepatitis B virus subtype ayw, complete genome, GenBank: U95551.1), SEQ ID NO: 650) (FIG. 5). Surprisingly, transcriptional repression of at least 80% persisted until 41-and 61-days post-transfection, indicating long lasting efficacy of the epigenetic editing, as the dCas9 fusion protein is no longer expressed by these late timepoints.

Figure 6A:
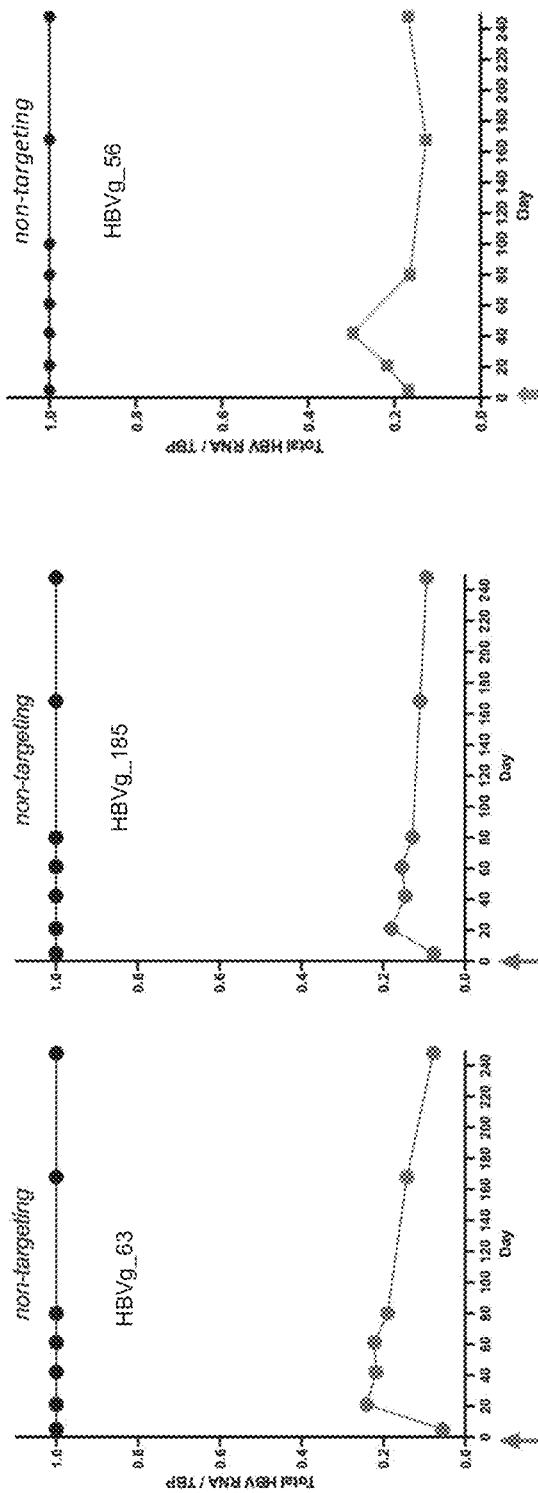
FIG. 6A-FIG. 6B depicts durable and stable repression of total HBV RNA mediated by gRNAs HBVg_63 (SEQ ID NO: 453), HBVg_185 (SEQ ID NO: 575), and HBVg_56 (SEQ ID NO: 446).
Figure 6B:
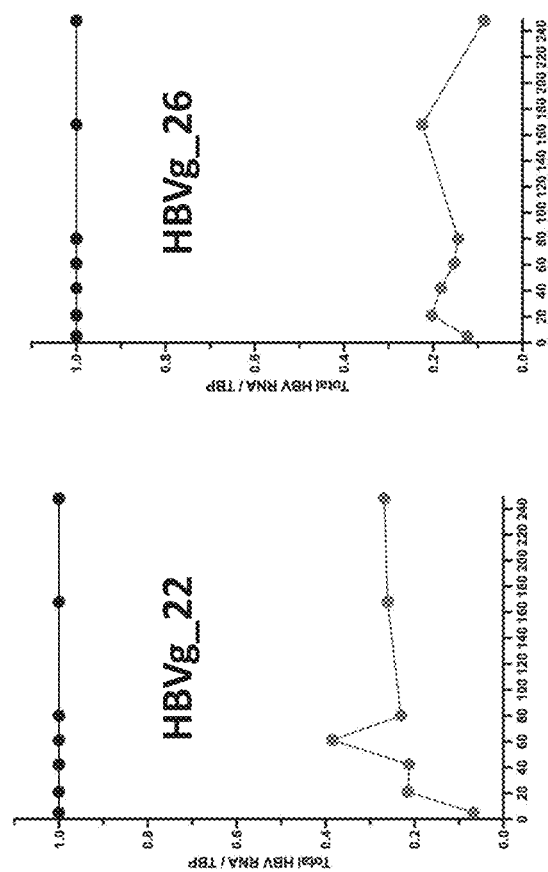

Transfected cells were also assessed for transcriptional repression of the targeted HBV transcripts at longer timepoints by qRT-PCR measurement of total HBV RNA transcript levels (FIGS. 6A-6B). Multiple gRNAs as set forth in SEQ ID NOs: 453 (HBVg_63), 575 (HBVg_185), 446 (HBVg_56), 412 (HBVg_22), and 416 (HBVg_26) showed therapeutically viable repression levels of integrated HBV RNA after 248 days and more than 120 cell doublings. Stable repression in total HBV RNA was achieved after a single dose of gRNA.

Figure 7:
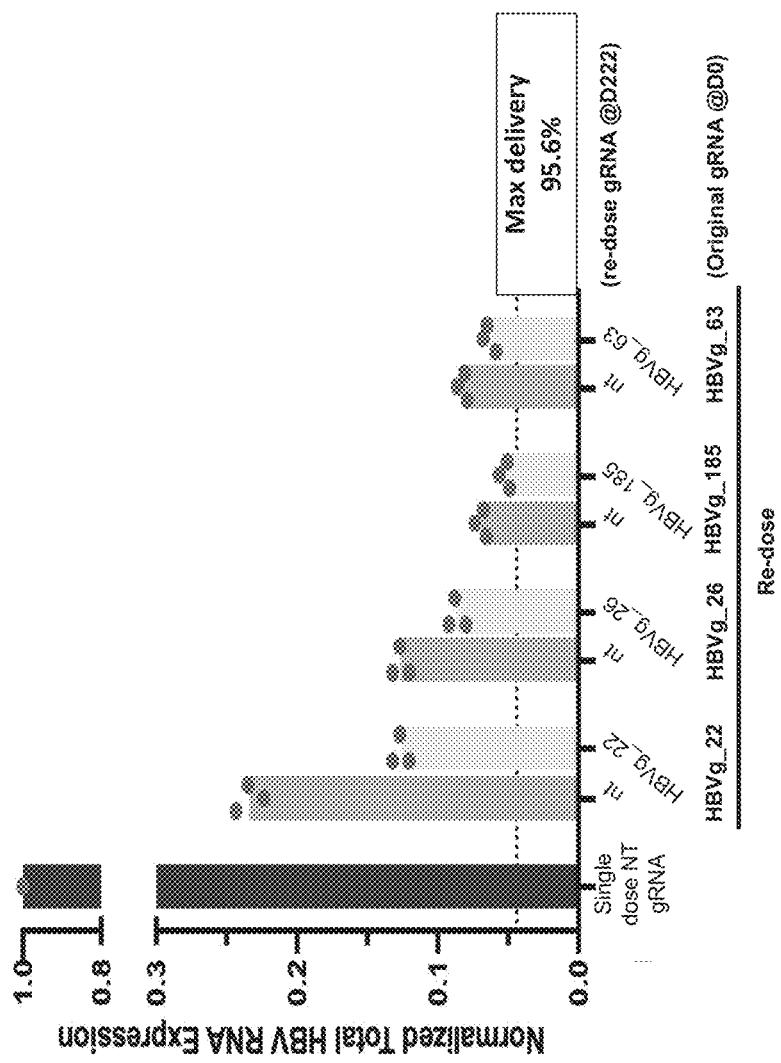
FIG. 7 shows normalized total HBV RNA expression after redosing with combinations of exemplary gRNAs and epi-editor.

Transfected cells from day 222 of the study were re-transfected with the same gRNA or non-targeting gRNA and the mRNA encoding DNMT3A/L-dSpCas9-KRAB fusion protein (SEQ ID NO: 644) using lipofectamine Messenger-Max. Total HBV RNA levels were examined four days after transfection to evaluate improvement in repression upon redosing. Guide RNAs HBVg_22 (SEQ ID NO: 412), HBVg26 (SEQ ID NO: 416), HBVg_185 (SEQ ID NO: 575), and HBVg_63 (SEQ ID NO: 453) showed significant repression after the first dose and showed further marked reductions in HBV RNA levels after redosing (FIG. 7). The effect was sustained as full repression for a given dose was reached. Near complete repression was achieved (95% bulk RNA) in almost all cells (~96%) once delivery was corrected for. Non-targeting gRNAs did not significantly affect repression levels as compared to non-treated control cells. Further studies to evaluate redosing at lower baseline delivery levels may be performed. Delivery and re-dosing in primary human hepatocytes and mouse models may be optimized.

II) Transient Arrayed Sreening for Modalators of Episomal ccDNA in a True Infection Model HepG2.NTCP cells dosed with HBV at 100 GE/cell were treated with control or standard of care treatment (e.g., nucleoside analogs such as Entecavir (ETV)) three days post HBV infection. HepG2.NTCP cells enable a true infection model of HBV as the HBV infection is sustained due to the generation and presence of native cccDNA. Six days after HBV infection, gRNAs targeting genes and regulatory elements thereof associated with HBV transcription, including those listed in Tables E1-E3 and Table 6, were transfected via lipofection into the cells expressing HBV from cccDNA together with an mRNA encoding the DNMT3A/L-dSpCas9-KRAB fusion protein (SEQ ID NO: 644) for transcriptional repression of gRNA-targeted HBV genes.

Figure 8:
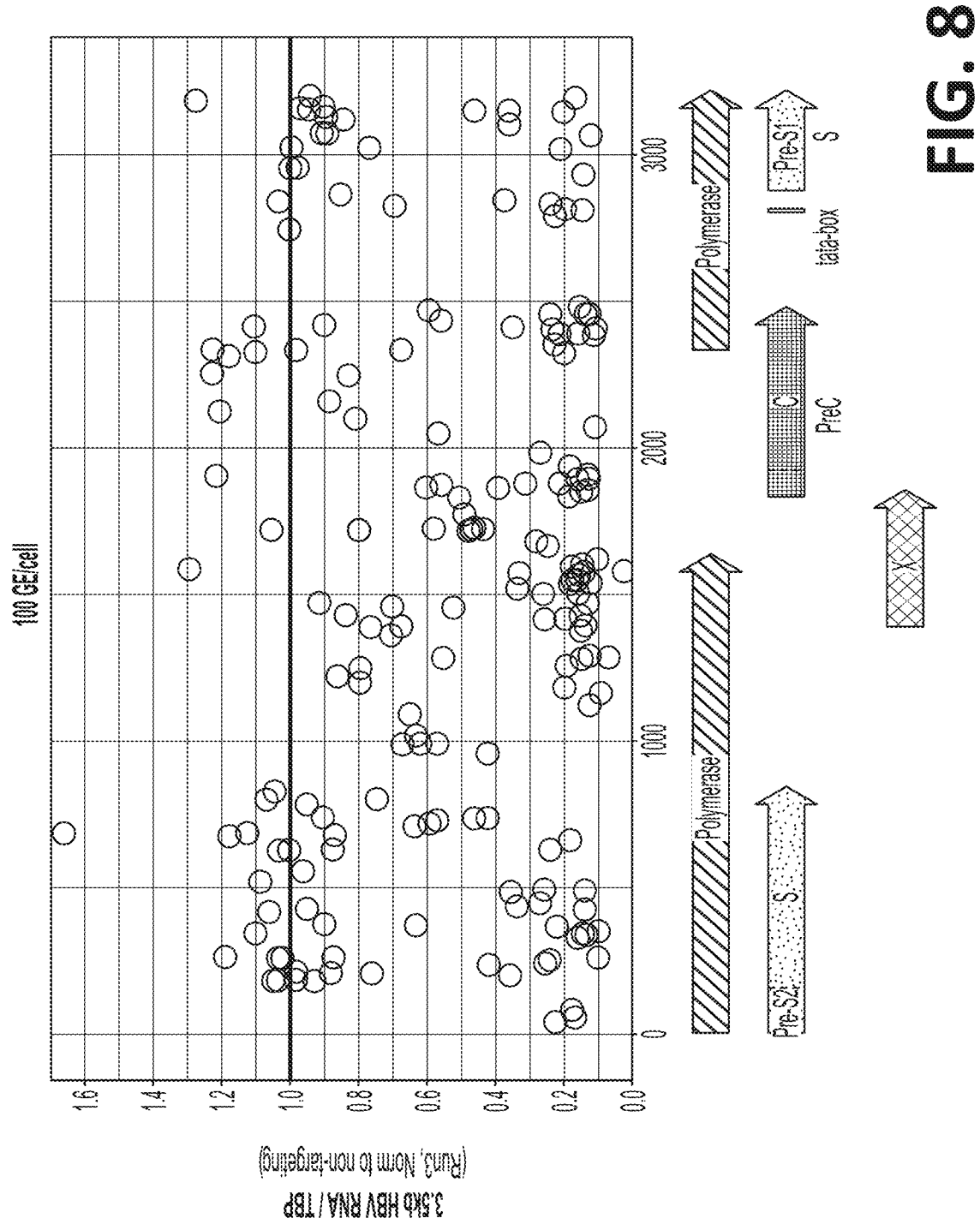
FIG. 8 depicts the fold change in 3.5 kilobase (kb) HBV RNA mediated by each guide RNA and a DNMT3A/L-dSpCas9-KRAB effector fusion protein in a true infection model. The fold change is depicted in relation to the median targeting position of each gRNA across the HBV genome.

Transfected cells were harvested and assessed on day 5 for transcriptional repression of the targeted HBV transcripts (either Total HBV RNA or 3.5 kB HBV RNAs). Measurements of 3.5 kb total HBV RNA transcript levels was performed via qRT-PCR, with one representative run shown (FIG. 8). Transfected cells may also be assessed for transcriptional repression by ELISA for reduction in Hepatitis B Surface Antigen (HBsAg) levels and Hepatitis B Virus core related-Antigen Protein (HBcrAg) levels from cccDNA. gRNAs were identified that mediated repression resulting in reduction of 3.5 kb total HBV RNA transcript levels by at least 80%.

FIG. 8 depicts the log fold change in 3.5 kb total HBV RNA for each gRNA from one replicate of the screen. The x-axis depicts the median targeting positions of each gRNA across the HBV genome. The gRNAs (HBVg_45: SEQ ID NO: 435, HBVg_22; SEQ ID NO: 412, HBVg_456: SEQ ID NO: 66, HBVg_6; SEQ ID NO: 396, HBVg_34: SEQ ID NO: 424, HBVg_182: SEQ ID NO: 572) with the highest transcriptional repression of 3.5 kb total HBV RNA targeted Enhancer 1/X promoter region and the Enhancer II regulatory element (HBV median position: 1580 bp (HBVg_45), (97.5%)), the polymerase gene and CpG island 2 (HBV median positions:1283 bp (HBVg_22) (93.0%) and 1162 bp (HBVg_66) (90.4%)), and the polymerase gene and CpG island 1 (HBV median positions: 261 bp (HBVg_6, and/or HBVg_34) (89.8%) and 349 bp (HBVg_182) (89.7%)).

Figure 9:
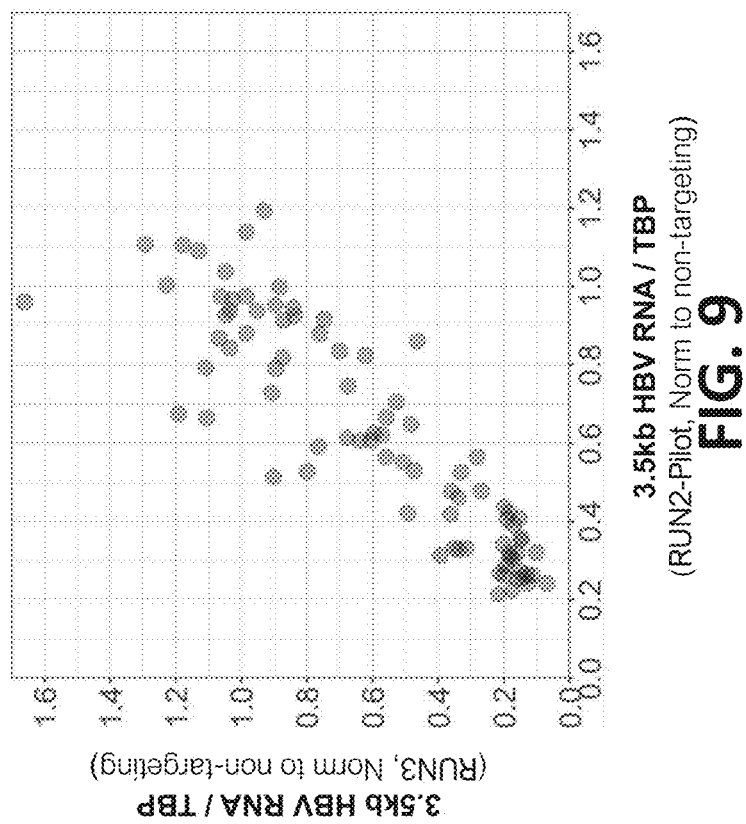
FIG. 9 shows infection-to-infection consistency using a correlation plot between two cccDNA screens.
Figure 10:
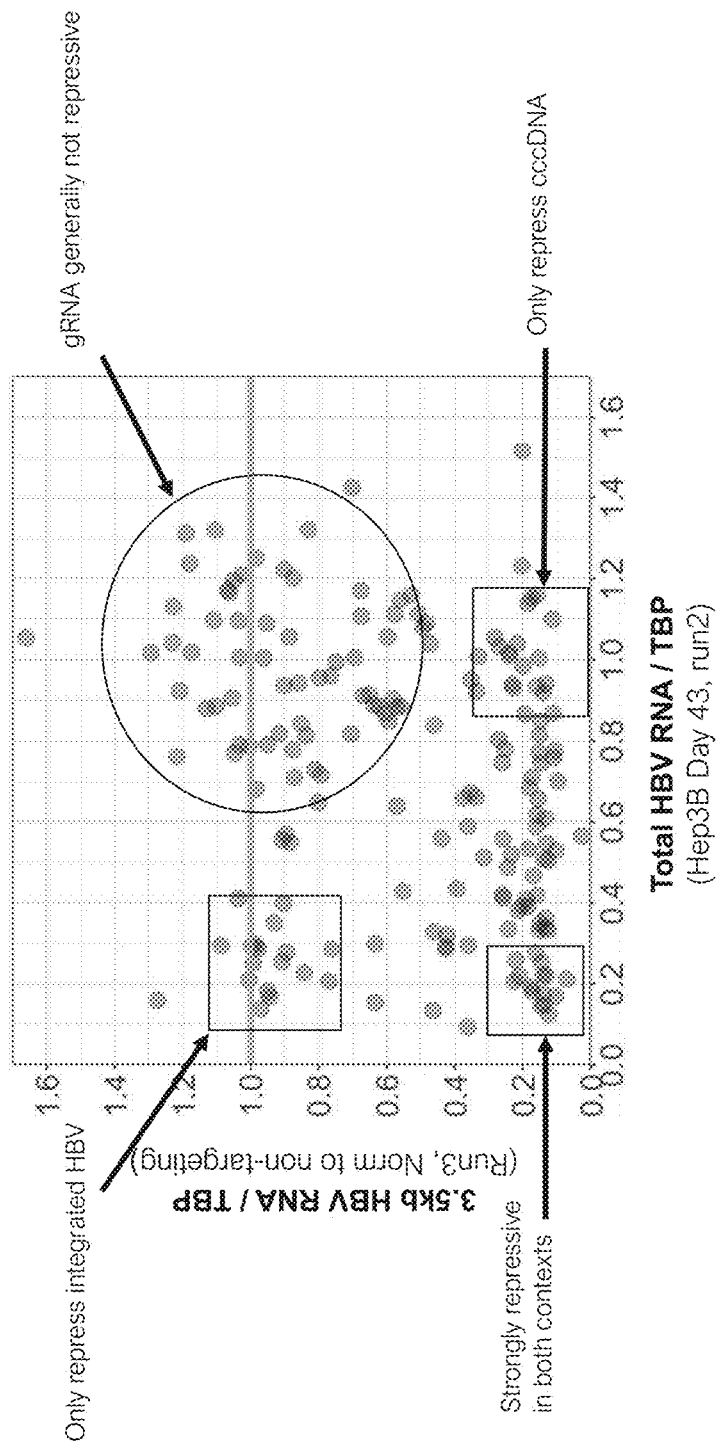
FIG. 10 shows gRNAs that either repressed integrated HBV, cccDNA, or both integrated and cccDNA.

A correlation plot of the cccDNA screen (rep #3) to another cccDNA screen (rep #2) showed infection-to-infection consistency (FIG. 9). gRNAs were identified that either repressed integrated HBV, cccDNA, or both integrated and cccDNA (FIG. 10). Finally, gRNAs were identified that achieved multiplexed HBV repression from a single gRNA. FIG. 11 lists sequences targeted by single gRNAs that achieved repression of multiple genes and regulatory elements (e.g., HBs/CpG Island 1, HBx/Enh1 enhancer/CpG Island 2). The repression was achieved within the integrated HBV DNA and cccDNA HBV genomes with high combined efficiencies. FIG. 12 lists sequences targeted by gRNAs (HBVg_22; SEQ ID NO: 412, HBVg_63; SEQ ID NO: 453, HBVg_185; SEQ ID NO: 575, HBVg_99: SEQ ID NO: 489), that achieve durable repression across multiple HBV transcripts (both integrated and cccDNA HBV depots). The repression is effective following a single transient delivery of mRNA/gRNA. These single gRNAs may be used in combination for multiplexed approaches.

Figure 13:
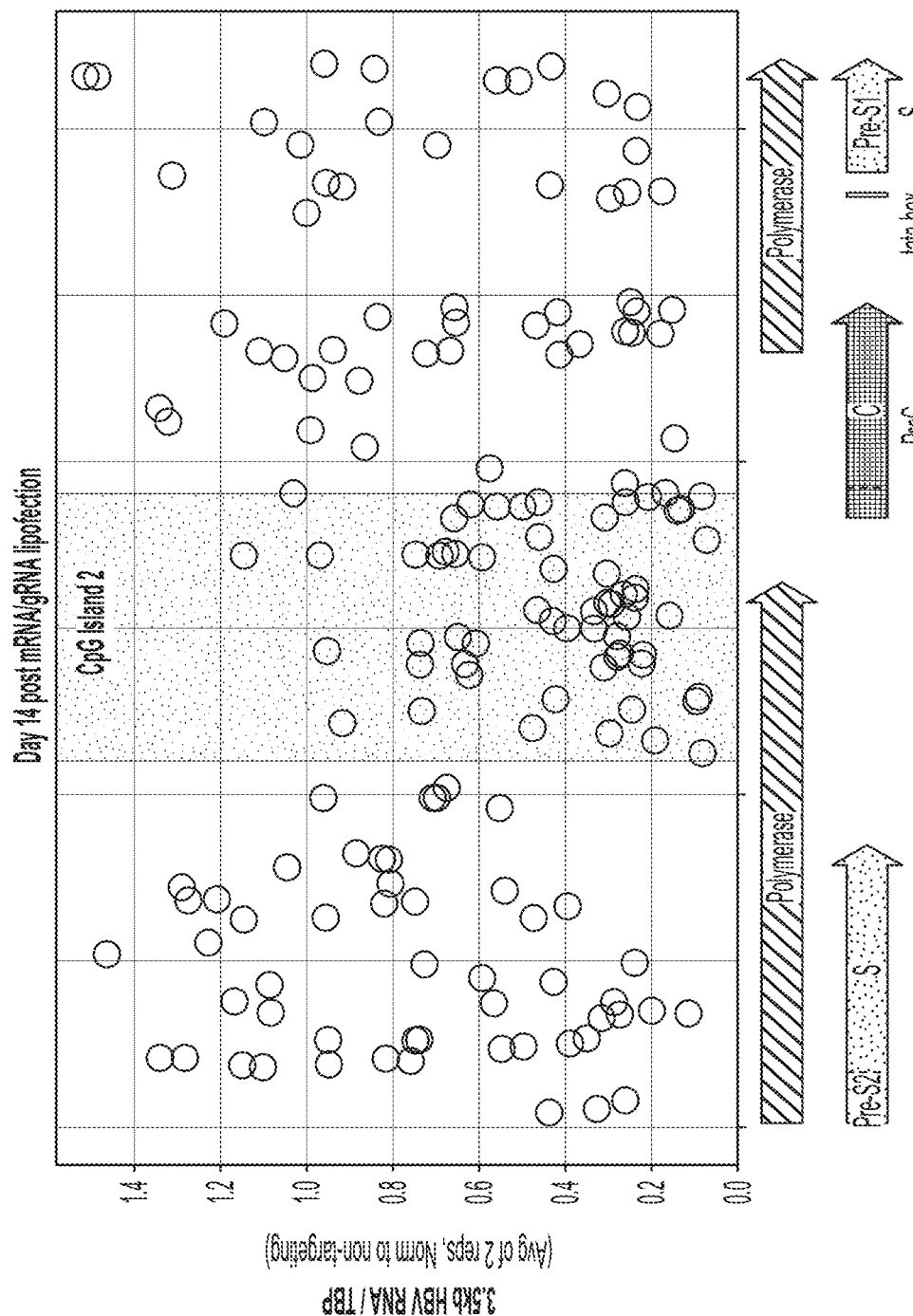
FIG. 13 depicts the fold change in total HBV RNA mediated by each guide RNA and an exemplary epi-editor. The fold change is depicted in relation to the median targeting position of each gRNA across the HBV genome.

Transfected cells were also harvested and assessed on day 14, a later timepoint, for transcriptional repression of the targeted HBV transcripts. Measurements of 3.5 kb total HBV RNA transcript levels was performed via qRT-PCR (FIG. 13). Transfected cells may also be assessed for transcriptional repression by ELISA for reduction in Hepatitis B Surface Antigen (HBsAg) levels and Hepatitis B Virus core related-Antigen Protein (HbcrAg) levels from cccDNA. FIG. 13 depicts the log fold change in 3.5 kb HBV RNA for each gRNA. The x-axis depicts the median targeting positions of each gRNA across the HBV genome. Multiple gRNAs (28/189) were identified that mediated repression of over 80% and up to 97.2% of the 3.5 kb HBV cccDNA. The gRNAs identified were HBVg_73 (SEQ ID NO: 463), HBVg_192 (SEQ ID NO: 582), HBVg_18 (SEQ ID NO: 408), HBVg_63 (SEQ ID NO: 453), HBVg_22 (SEQ ID NO: 412), HBVg_185 (SEQ ID NO: 575), HBVg_46 (SEQ ID NO: 436), HBVg_99 (SEQ ID NO: 489), HBVg_162 (SEQ ID NO: 552), HBVg_174 (SEQ ID NO: 568), HBVg_20 (SEQ ID NO: 410), HBVg_79 (SEQ ID NO: 469), HBVg_50 (SEQ ID NO: 440), HBVg_79 (SEQ ID NO: 469), HBVg_50 (440), HBVg_27 (SEQ ID NO: 417), HBVg_182 (SEQ ID NO: 572), and HBVg_12 (SEQ ID NO: 402).

Figure 14:
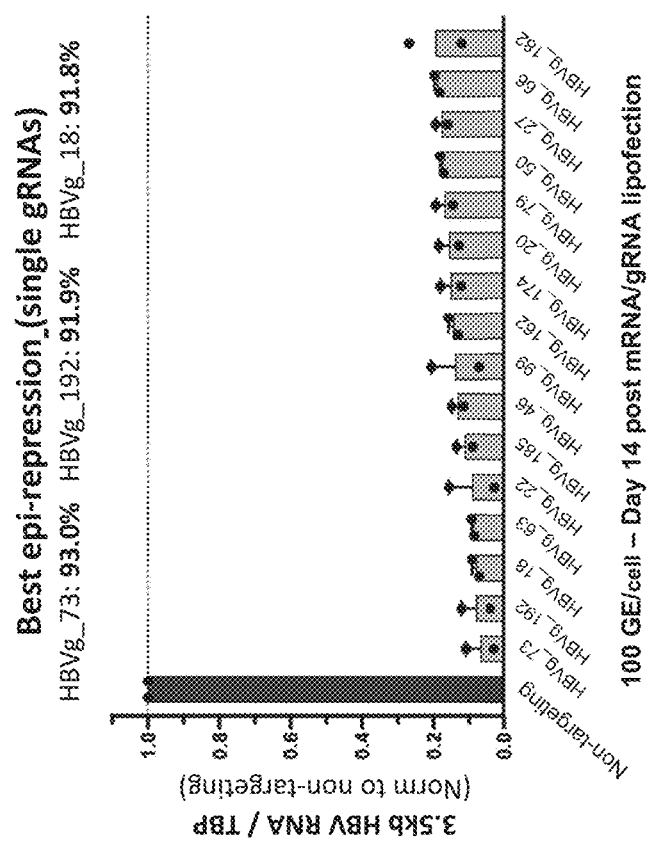
FIG. 14 shows repression of targeted HBV cccDNA transcripts by individual gRNAs.

FIG. 14 shows repression of the targeted HBV cccDNA transcripts by single gRNAs HBVg_73 (SEQ ID NO: 463), HBVg_192 (SEQ ID NO: 582), HBVg_18 (SEQ ID NO: 408), HBVg_63 (SEQ ID NO: 456), HBVg_22 (SEQ ID NO: 412), HBVg_185 (SEQ ID NO: 575), HBVg_46 (SEQ ID NO: 436), HBVg_99 (SEQ ID NO: 489), HBVg_162 (SEQ ID NO: 552), HBVg_174 (SEQ ID NO: 564), HBVg_5 (SEQ ID NO: 410), HBVg_79 (SEQ ID NO: 469), HBVg_50 (SEQ ID NO: 440), HBVg_27 (SEQ ID NO: 417), HBVg_66 (SEQ ID NO: 456), and HBVg_182 (SEQ ID NO: 572). The sites targeted by the gRNAs were also 92% conserved across HBV genotypes. Guide RNAs HBVg_73 (SEQ ID NO: 463) (93%), HBVg_192 (SEQ ID NO: 582) (91.9%), and HBVg_18 (SEQ ID NO: 408) (91.8%) mediated the highest repression.

Figure 15A:
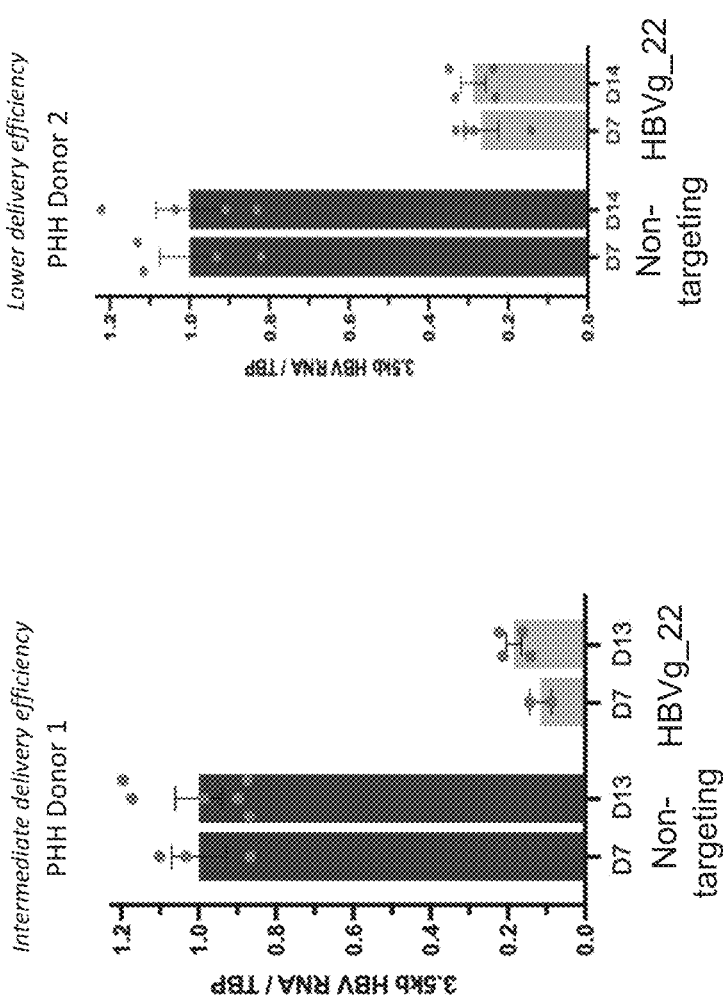
FIG. 15A-FIG. 15B depicts repression of cccDNA in primary human hepatocyte (PHH) infection models.

Example 3: Strong Repression of cccDNA Achieved in Primary Human Hepatocyte (PHH) Infection Models To evaluate the gRNA mediated epi-editing in a more native context, primary human hepatocyte (PHH) infection models were used. Primary human hepatocytes from two donors (PHH Donor 1 and PHH Donor 2) were used for these experiments, with both donors infected with HBV at 100 GE/cell and infection allowed to develop for five days in culture. The cells were then transfected with mRNA encoding DNMT3A/L-dSpCas9-KRAB (SEQ ID NO: 644) and gRNA HBVg_22 (SEQ ID NO:412) and evaluated for repression via RNA isolation and qPCR. FIG. 15A shows repression of HBV RNA in both donors on day 7 and day 13/14. PHH donor 2 supported approximately 5 times higher levels of infection at baseline as compared to PHH donor 1 at the same dose. Despite the large differences in delivery efficiencies, both PHH donors showed strong and durable cccDNA repression with HBVg_22 (SEQ ID NO: 412).

Figure 15B:
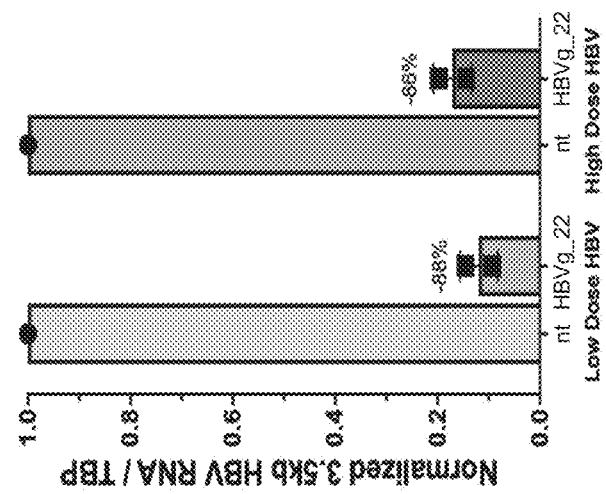

Primary human hepatocytes from donor 1 were seeded on two collagen-coated 24-well plates at $0.2 \times 10^6$ cells/cm$^2$. Twenty-four hours post seeding, cells were infected with HBV at 100 GE/cell and 200 GE/cell and evaluated for infection via RNA isolation and qPCR of the 3.5 kb HBV transcript. The cells were then transfected with mRNA encoding DNMT3A/L-dSpCas9-KRAB (SEQ ID NO: 644) and gRNA (SEQ ID NO:412) and were evaluated for repression after six days via RNA isolation and qPCR. FIG. 15B shows strong repression in the PHH infection models infected with low dose HBV (1×3.5 kb HBV transcript basally) and high dose HBV (12×3.5 kb transcript basally). The results show that significant repression was achieved in both low and high dose groups. The repression was maintained across a large window of HBV RNA expression (12-fold between both doses).

Figures 16A, 16B:
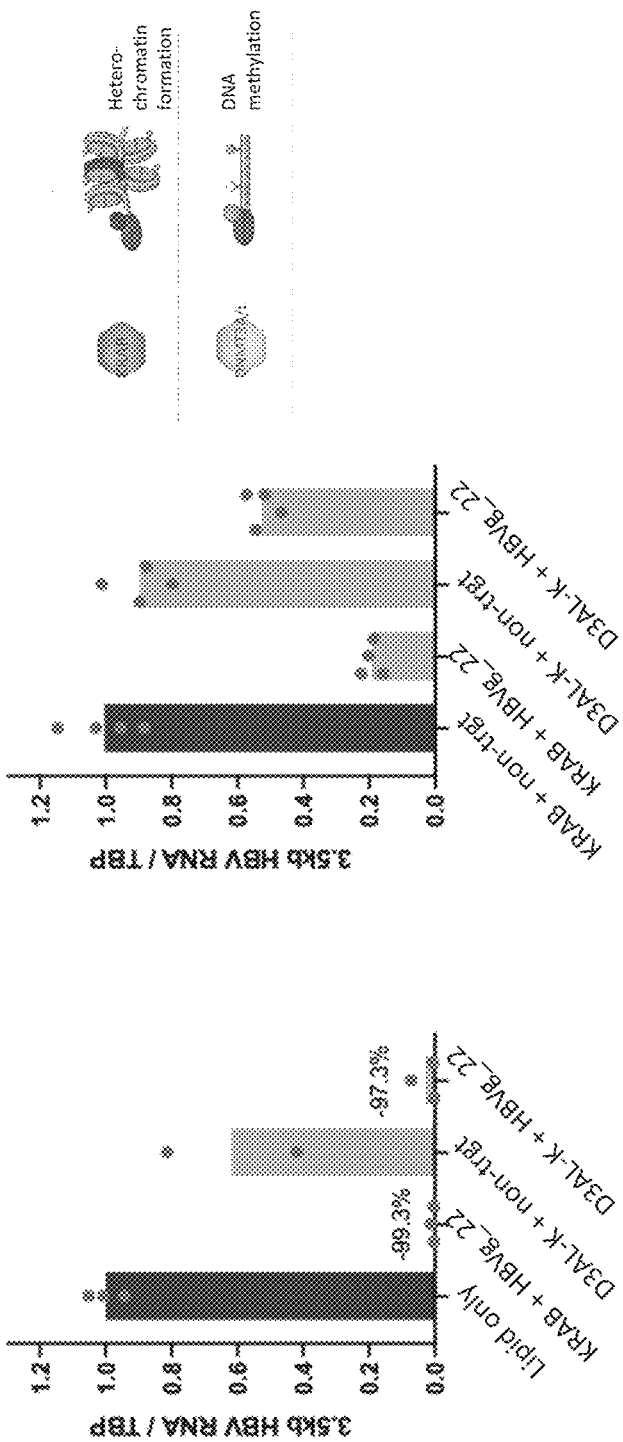
FIG. 16A-FIG. 16B show comparisons between repression mediated by HBVg_22 (SEQ ID NO: 412) in combination with either dSpCas9-KRAB alone (SEQ ID NO:595) or DNMT3A/L-dSpCas9-KRAB ("D3AL-K"; SEQ ID NO: 645) fusion in HepG2.NTCP (FIG. 16A) and PxB PHH (FIG. 16B) models.

Example 4: Comparison Between Repression Induced by dSpCas9-KRAB and DNMT3A/L-dSpCas9-KRAB Fusion Proteins To compare the repression induced by dSpCas9-KRAB and DNMT3A/L-dSpCas9-KRAB fusion proteins, HepG2.NTCP and PxB PHH cells were transfected with mRNA encoding HBVg_22 (SEQ ID NO: 412) in combination with either dSpCas9-KRAB alone (SEQ ID NO:595) or DNMT3A/L-dSpCas9-KRAB ("D3AL-K"; SEQ ID NO: 645). The cells were evaluated for repression after either 20 days or 14 days via RNA isolation and qPCR. FIG. 16A-16B shows a comparison between repression induced by HBVg_22 (SEQ ID NO: 412) in combination with either dSpCas9-KRAB alone (SEQ ID NO:595) or DNMT3A/L-dSpCas9-KRAB ("D3AL-K"; SEQ ID NO: 645) fusion in HepG2.NTCP and PxB PHH models. Transient delivery of dCas9-KRAB alone can engender long-term repression of cccDNA across multiple cell contexts. However, transient delivery of dCas9-KRAB alone does not enable long-term repression of integrated HBV DNA. This shows that methylation (e.g., by D3AL-K) is required for durable transcriptional repression of HBV RNA from HBV integrants, and some degree of durable cccDNA silencing can be achieved without DNMTR3A/3L domains.

Example 5: Multiplexed Targeted Transcriptional Repression for Promoting Phenotypes for Silencing HBV Replication and Expression DNA-targeting systems comprising different combinations of the gRNAs identified in Example 2 were screened to identify conditions in which multiplexed targeted transcriptional repression of at least two genes or regulatory elements thereof promotes phenotypes for silencing HBV replication and expression.

DNA-targeting systems comprising gRNAs and an mRNA encoding a dSpCas9-effector are transiently transfected into cell lines expressing HBV from integrated sequences and cccDNA. gRNAs are transfected individually, or in combinations of 2 gRNAs, 3 gRNAs, or 4 gRNAs, with each gRNA targeting a different gene or regulatory elements. Alternatively, gRNAs are transfected individually, or in combinations of 2 gRNAs, 3 gRNAs, or 4 gRNAs, with each gRNA targeting a different target site within the same gene or regulatory element.

In one example, a combination of 2 gRNAs comprises a first gRNA targeting one of Enh1/X-promoter, Enh2/Basal core promoter, L-HBs promoter, M/S-HBs promoter, and a second gRNA targeting one of Enh1/X-promoter, Enh2/Basal core promoter, L-HBs promoter, and M/S-HBs promoter, wherein the first and second gRNA target different regulatory elements. In another example, a combination of 2 gRNAs comprises a first gRNA targeting Enh1/X-promoter and a second gRNA targeting one of Enh2/Basal core promoter, L-HBs promoter, and M/S-HBs promoter. In another example, a combination of 2 gRNAs comprises a first gRNA targeting Enh1/X-promoter and a second gRNA targeting L-HBs promoter.

In another example, a combination of 3 gRNAs comprises a first gRNA targeting one of Enh1/X-promoter, Enh2/Basal core promoter, L-HBs promoter, and M/S-HBs promoter, a second gRNA targeting one of Enh1/X-promoter, Enh2/Basal core promoter, L-HBs promoter, and M/S-HBs promoter, and a third gRNA targeting one of Enh1/X-promoter, Enh2/Basal core promoter, L-HBs promoter, wherein the second and third gRNA each target a different regulatory element. In another example, a combination of 3 gRNAs comprises a first gRNA targeting Enh1/X-promoter, a second gRNA targeting a Enh2/Basal core promoter, and a third gRNA targeting L-HBs promoter.

In another example, a combination of 4 gRNAs comprises a first gRNA targeting one of Enh1/X-promoter, Enh2/Basal core promoter, L-HBs promoter, and M/S-HBs promoter, a second gRNA targeting one of Enh1/X-promoter, Enh2/Basal core promoter, L-HBs promoter, and M/S-HBs promoter, a third gRNA targeting one of Enh1/X-promoter, Enh2/Basal core promoter, L-HBs promoter, and a fourth gRNA targeting one of Enh1/X-promoter, Enh2/Basal core promoter, L-HBs promoter, wherein the first, second, third, and fourth gRNA targets a different regulatory element.

In another example, a combination of 3 gRNAs comprises a first gRNA targeting one of L-HBs promoter, and M/S-HBs promoter, a second gRNA targeting the Enh2/Basal core promoter, and a third gRNA targeting the Enh1/X-promoter.

In another example, a combination of 4 gRNAs comprises gRNAs targeting each of the L-HBs and M/S-HBs promoters, and a gRNA targeting the Enh2/Basal core promoter.

Following transfection, cells are assessed for phenotypes that could promote phenotypes for silencing HBV replication and expression. Specifically, transfected cells are assessed for transcriptional repression of the targeted HBV transcripts by qRT-PCR measurement of total HBV RNA transcript levels or 3.5 kb HBV RNA transcript levels. In addition, conditions are identified in which multiplexed targeted repression of a combination of genes and/or regulatory elements thereof (e.g. Enh1/X-promoter and L-HBs promoter) leads to reduced HBV RNA than targeted repression of any individual gene of the combination alone (e.g. Enh1/X-promoter alone or L-HBs promoter alone).

DNA-targeting systems with combinations of gRNAs are identified that mediate multiplexed targeted transcriptional repression to silence HBV replication and expression.

Figure 17:
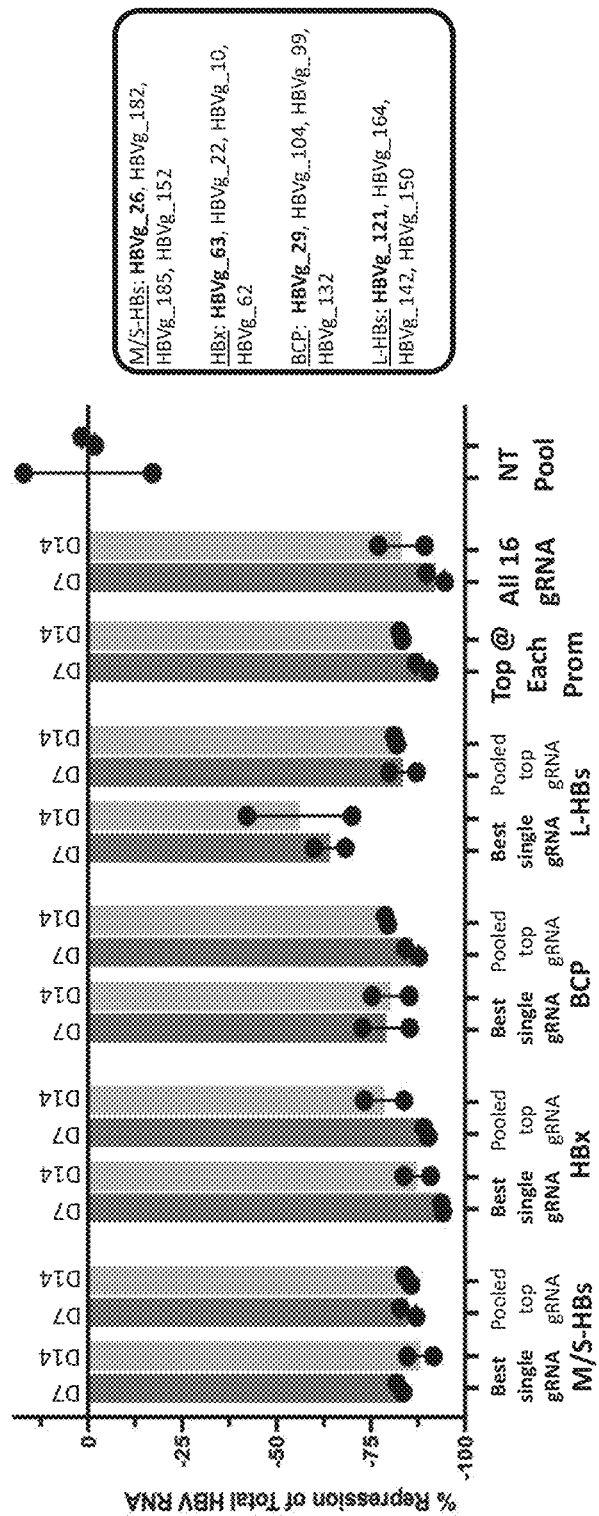
FIG. 17 depicts multiplexed targeted transcriptional repression of different regions within the HBV RNA in Hep3B cells.

FIG. 17 shows combinations of gRNAs that mediate multiplexed targeted transcriptional repression of different regions within the HBV RNA in Hep3B cells. Multiple gRNAs that mediated the most repression were pooled and compared to repression induced by single gRNAs (e.g., "best single gRNAs" such as HBVg_26, HBVg_63, HBVg_29, and HBVg_121) and non-targeted gRNAs. The gRNAs were transfected via lipofection with standard dose (20 ng) pooled to maintain a 1x dosage (e.g., "pooled top gRNAs"=1x/4=5 ng per, or "all 16 gRNAs"=1x/16=1.25 ng per) for high expression. As shown in FIG. 17, gRNAs targeting different regions mediated repression as compared to the non-targeting control. However, combinations of multiple gRNAs did not always significantly improve repression as compared to single gRNAs. For example, HBVg_26 (SEQ ID NO: 416) alone mediated comparable repression as compared to a pool of top gRNAs (a combination of HBVg_26 (SEQ ID NO: 416), HBVg_182 (SEQ ID NO: 572), HBVg_185 (SEQ ID NO: 575), and HBVg_152 (SEQ ID NO: 542)) in the M/S-HBs promoter region. However, a pool of the top gRNA at the L-HBs promoter, or a pool with the top single gRNA from each promoter was able to increase repression relative to the best single gRNA from the L-HBs promoter. Together this highlights the context sensitivity for multiplexing gRNA in relation to HBV repression.

Figure 18:
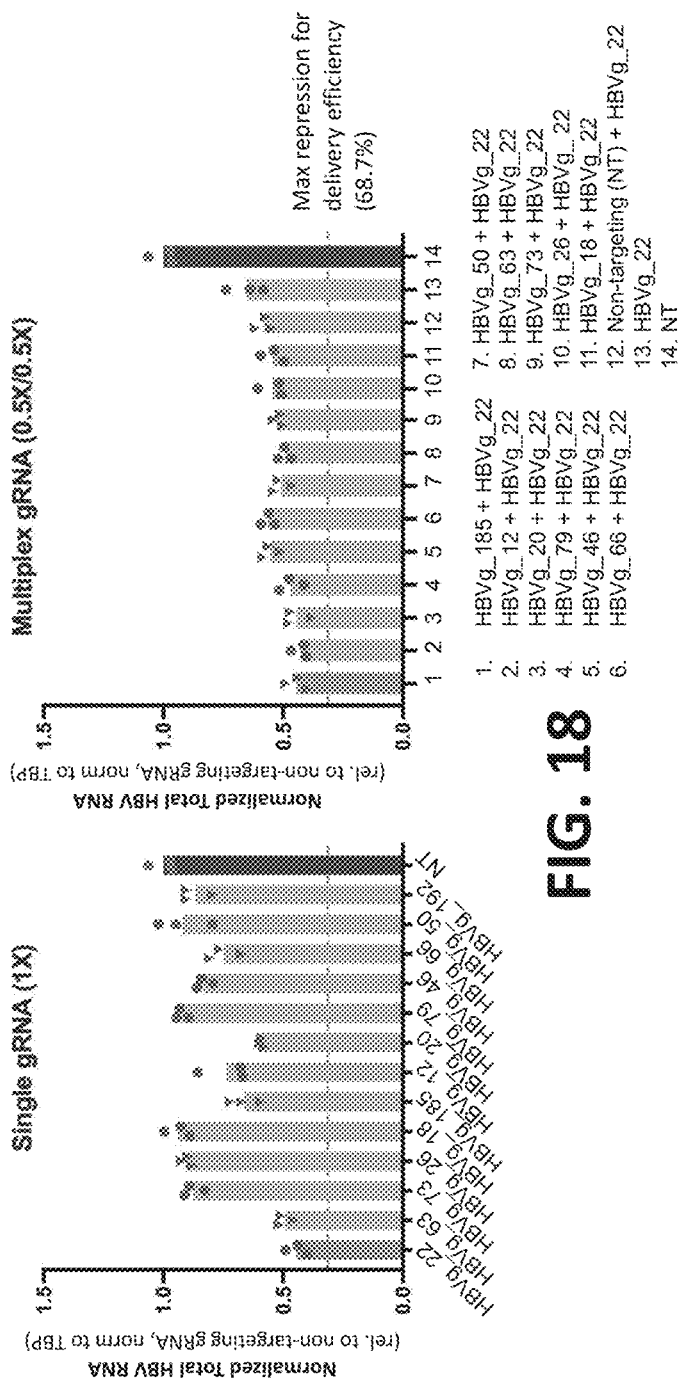
FIG. 18 shows repression mediated by either individual gRNAs or multiplexed gRNAs in PLC/PRF/5 (Alexander) cell models.

Combinations of gRNAs were tested for multiplexed transcriptional repression in a PLC/PRF/5 (Alexander) cell model with poor lipofection capacity. PLC/PRF/5 is a human liver cancer cell line that produces all isoforms of hepatitis B virus surface antigen (HbsAg), including L-HBs, M-HBs, and S-HBs. The cell line contains 8-10 integrations of the HBV as compared to approximately 2 integrations and M/S-HBs isoforms in Hep3B cells. Fourteen days post lipofection with an mRNA encoding D3AL-K and various gRNA combinations, RNA was harvested and a qPCR was run for Total HBV RNA. FIG. 18 shows that HBVg_22 (SEQ ID NO: 412) alone mediated the greatest repression at day 14, followed by HBVg_63 (SEQ ID NO: 453) and HBVg_20 (SEQ ID NO: 410). Many gRNAs do not have functional targeting in these cells. Multiplexing gRNAs did not significantly improve (or hinder) repression as compared to HBVg_22 (SEQ ID NO: 412) alone.

Figure 19:
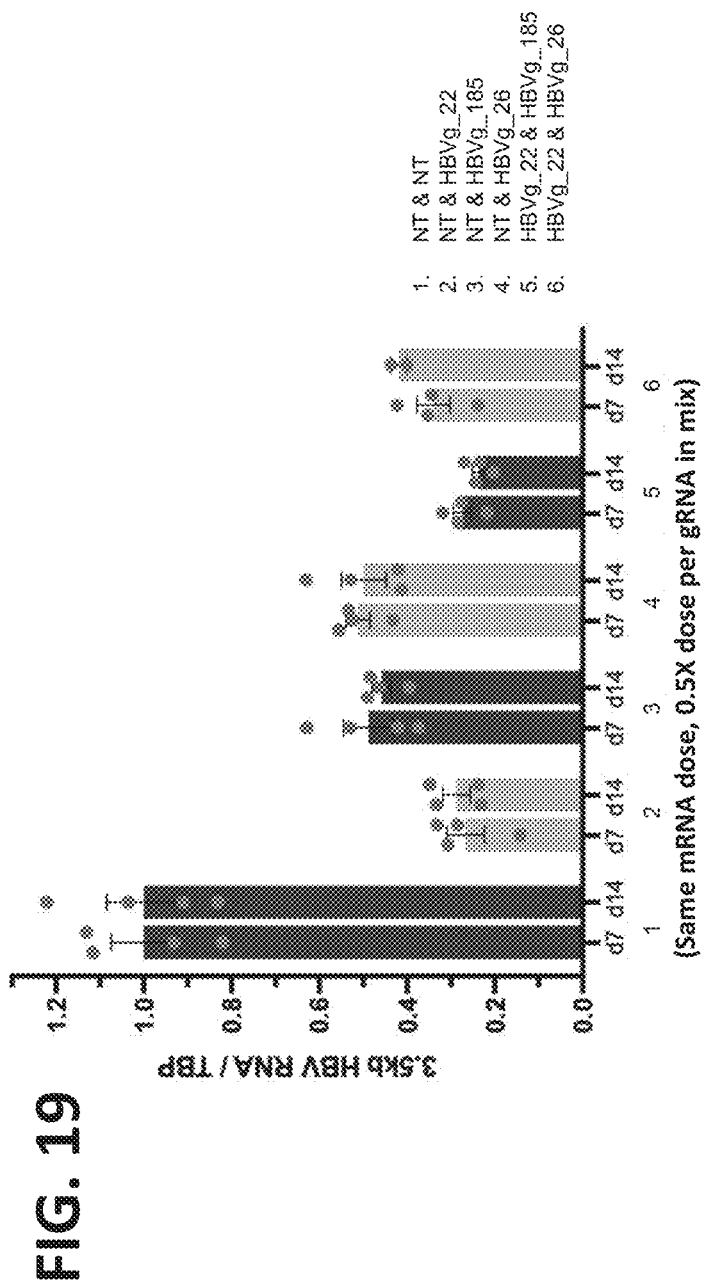
FIG. 19 shows a multiplexed approach with a combination of two gRNAs with an exemplary dSpCas9-effector in PXB primary human hepatocyte (PHH) cell models.

In another multiplexed assay, PXB primary human hepatocytes (PHH) cells were infected with HBV at a multiplicity of infection (MOI) of 100 and allowed to progress for five days. The cells were then lipofected with DNMT3A/L-dSpCas9-KRAB (SEQ ID NO: 644) and various multiplexed gRNA mixtures, such that each gRNA was dosed at 0.5×. Repression of pgRNA was assayed at day 7 and day 14 post-lipofection. FIG. 19 shows comparable durability of multiplexed targeted transcriptional repression mediated by HBVg_22 (SEQ ID NO: 412), HBVg_185 (SEQ ID NO: 575), and HBVg_26 (SEQ ID NO: 416).

Example 6. On-Target Methylation of cccDNA and Integrated HBV DNA

Figure 20A:
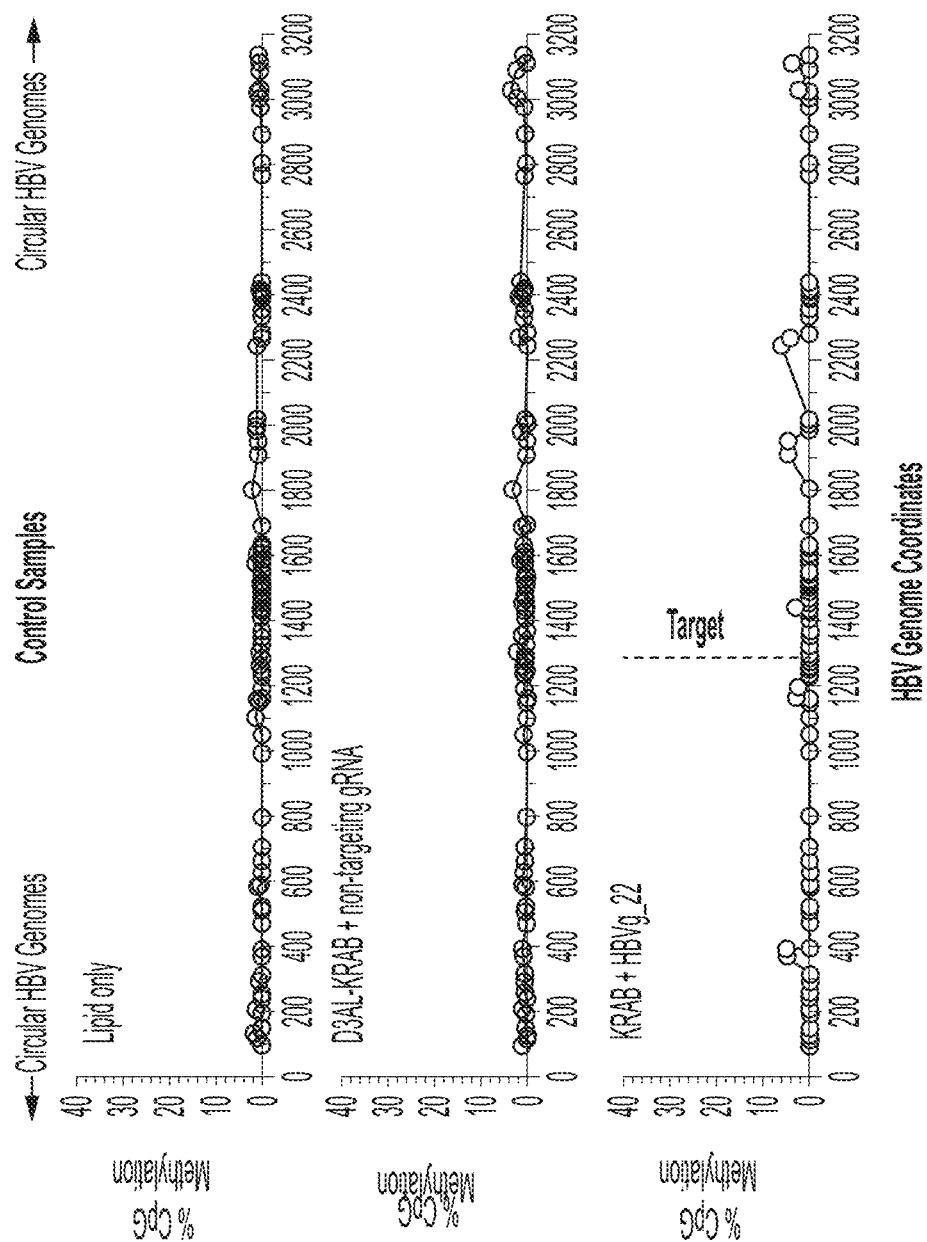
FIG. 20A and FIG. 20B show methyl capture sequencing analysis of cccDNA and integrated HBV DNA.
Figure 20B:
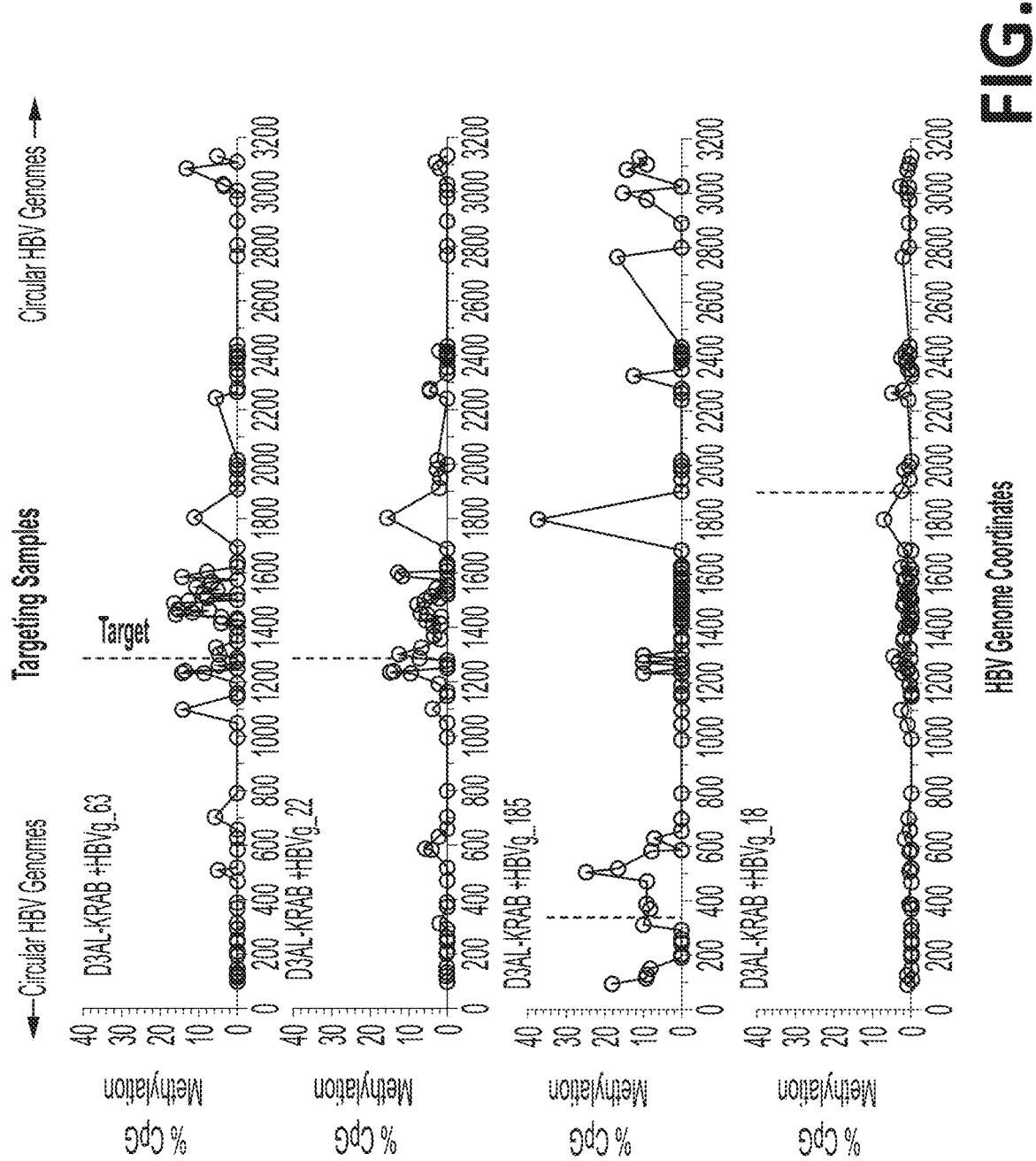
Figure 21A:
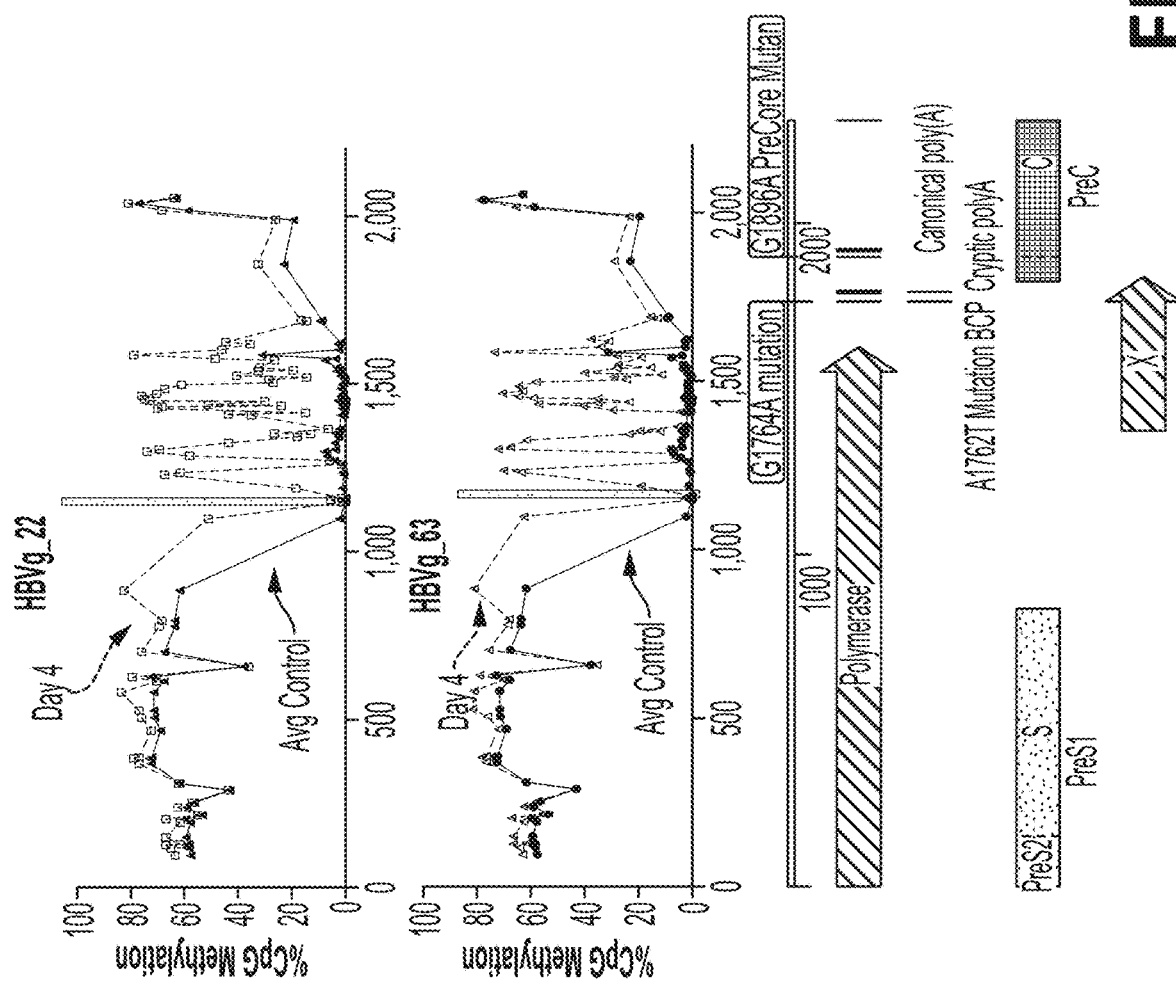
FIG. 21A-FIG. 21B show increased methylation patterns following delivery of mRNA encoding DNMT3A/L-dSpCas9-KRAB along with various gRNA.
Figure 21B:
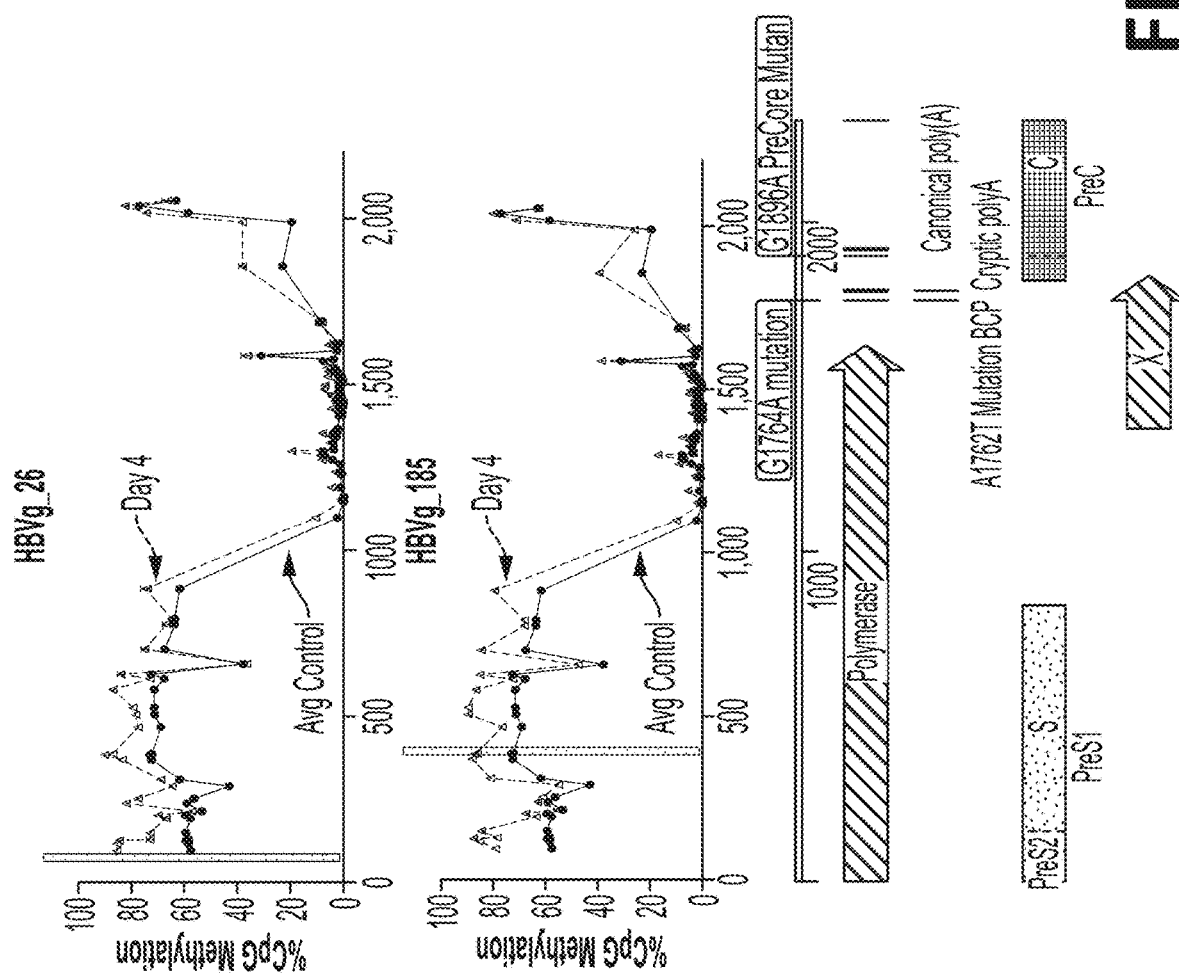
Figure 22:
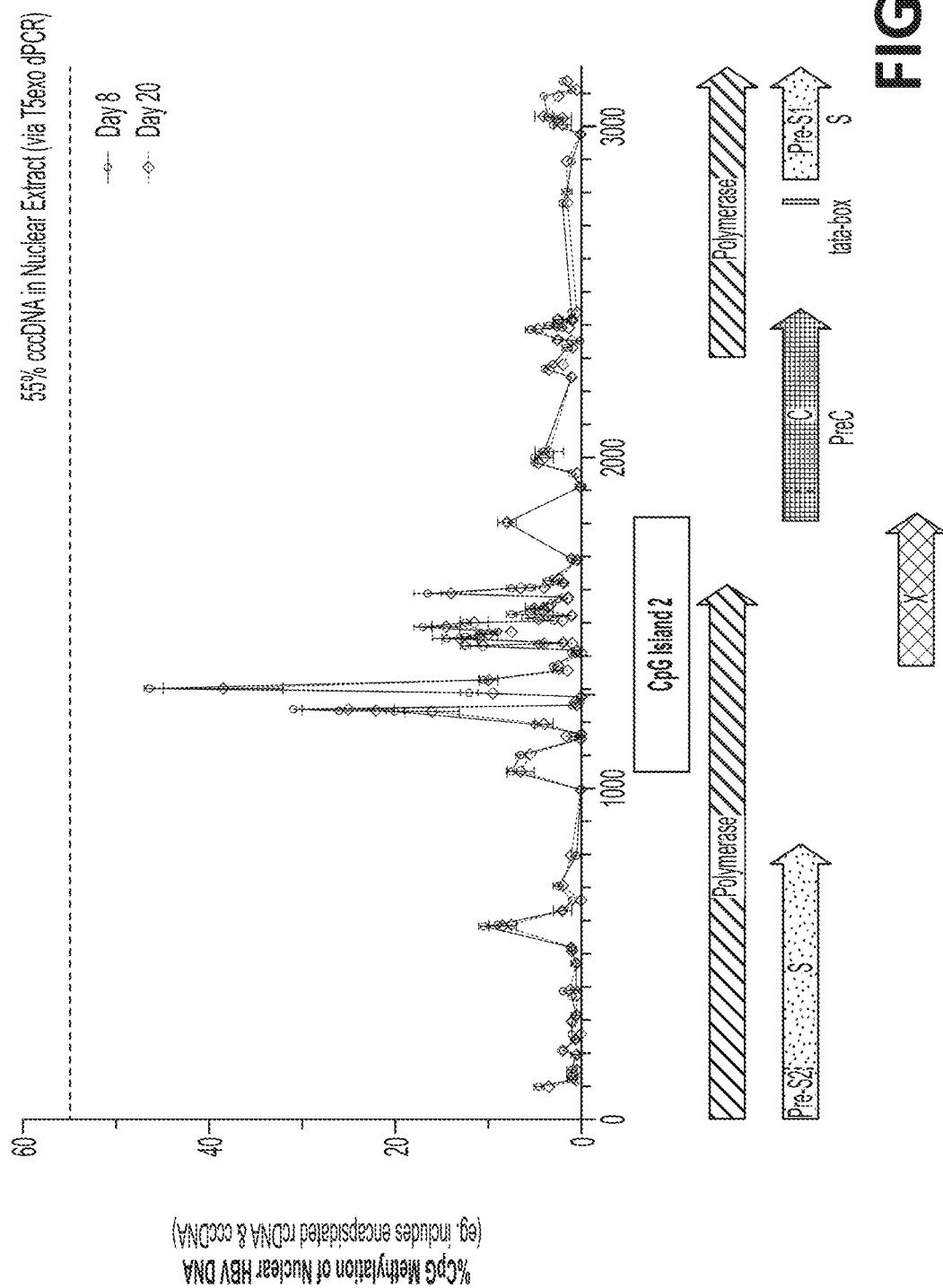
FIG. 22 shows durable CpG island 2 methylation patterns following delivery of mRNA encoding DNMT3A/L-dCas9-KRAB and HBVg_22 (SEQ ID NO: 412) to HBV-infected PHH donor.

To evaluate target specificity, HepG2.NTCP cells were transfected with either lipid only control, non-targeting gRNA control with an mRNA encoding either a DNMT3A/L-dSpCas9-KRAB fusion construct (SEQ ID NO: 644), dSpCas9-KRAB construct (SEQ ID NO: 594) with a gRNA (demethylase-null control), or with the DNMT3A/L-dSpCas9-KRAB fusion construct (SEQ ID NO: 644) in combination with a gRNA, at maximum dose (FIGS. 20A and B). Methyl capture sequencing using a custom HBV Methylome library was performed three days after lipofection. As seen in FIG. 20A, little to no methylation was seen in the lipid only, non-targeting, and demethylase-null controls. However, the DNMT3A/L-dSpCas9-KRAB fusion (SEQ ID NO: 644) in combination with various gRNAs (FIG. 20B) showed targeted and distinct patters of methylation across the HBV genome in unenriched total HBV DNA pool. Methyl sequencing confirmed specific and robust methylation pattern deposited by the DNMT3A/L-dSpCas9-KRAB fusion protein across the HBV genome. FIG. 21 shows increased methylation patterns in integrated HBV DNA following delivery of mRNA encoding DNMT3A/L-dSpCas9-KRAB along with various gRNA (HBVg_22 (SEQ ID NO: 412), HBVg26 (SEQ ID NO: 416), HBVg_63 (SEQ ID NO: 453), HBVg_185 (SEQ ID NO: 575) in Hep3B cells. These methylation patterns showed similar trends across the HBV genome to those seen in cccDNA in FIG. 20B. FIG. 22 shows methylation patterns following nuclei isolation in HBV-infected PHH donor #1 (100 Ge/cell) following transient lipofection with HBVg_22 (SEQ ID NO: 412) and mRNA encoding D3AL-K. This isolation of nuclei prior to Methyl-seq reduces rcDNA contamination in the preps and allows for enrichment of the cccDNA signal (55% of HBV DNA captured). This methylation data is similar to other patterns seen for HBVg_22 (SEQ ID NO: 412), and highlights the durability of these epi-genetic changes over time.

Figure 23B:
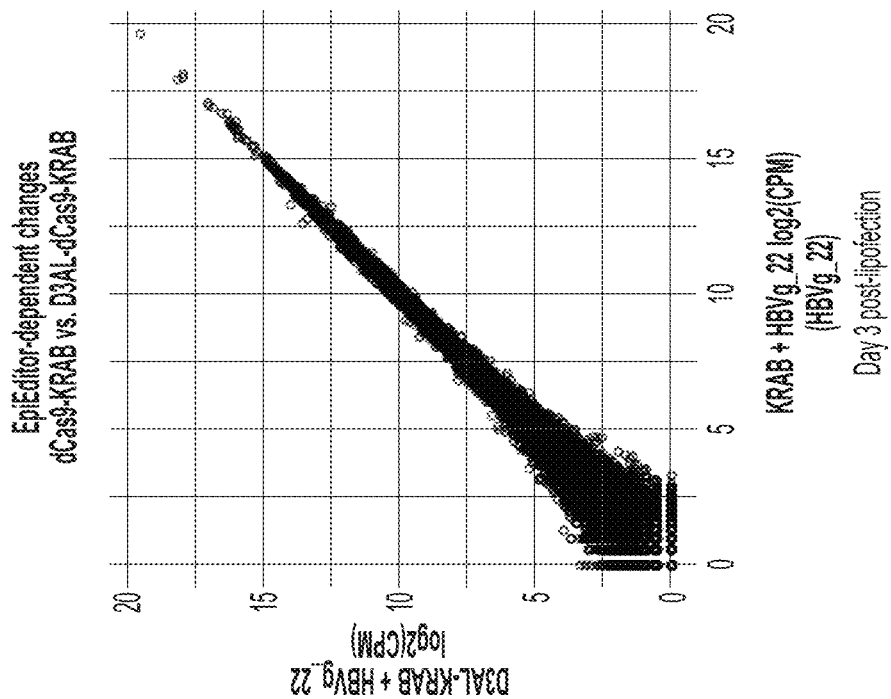
FIG. 23A and FIG. 23B reveal RNA sequencing analysis of gRNA-dependent and epi-editor dependent changes on gene expression.
Figure 23A:
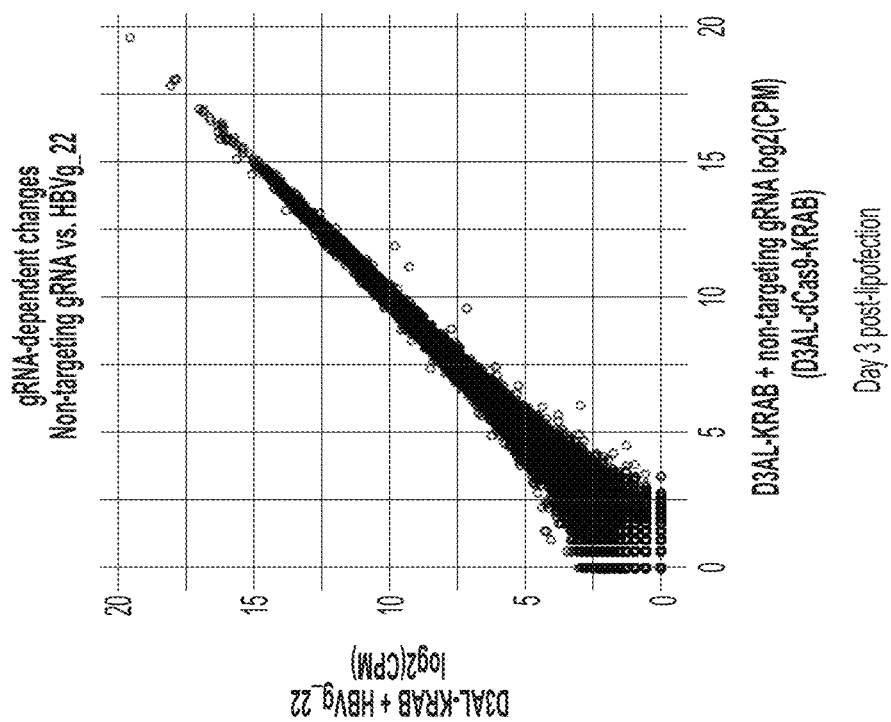
Figure 23C:
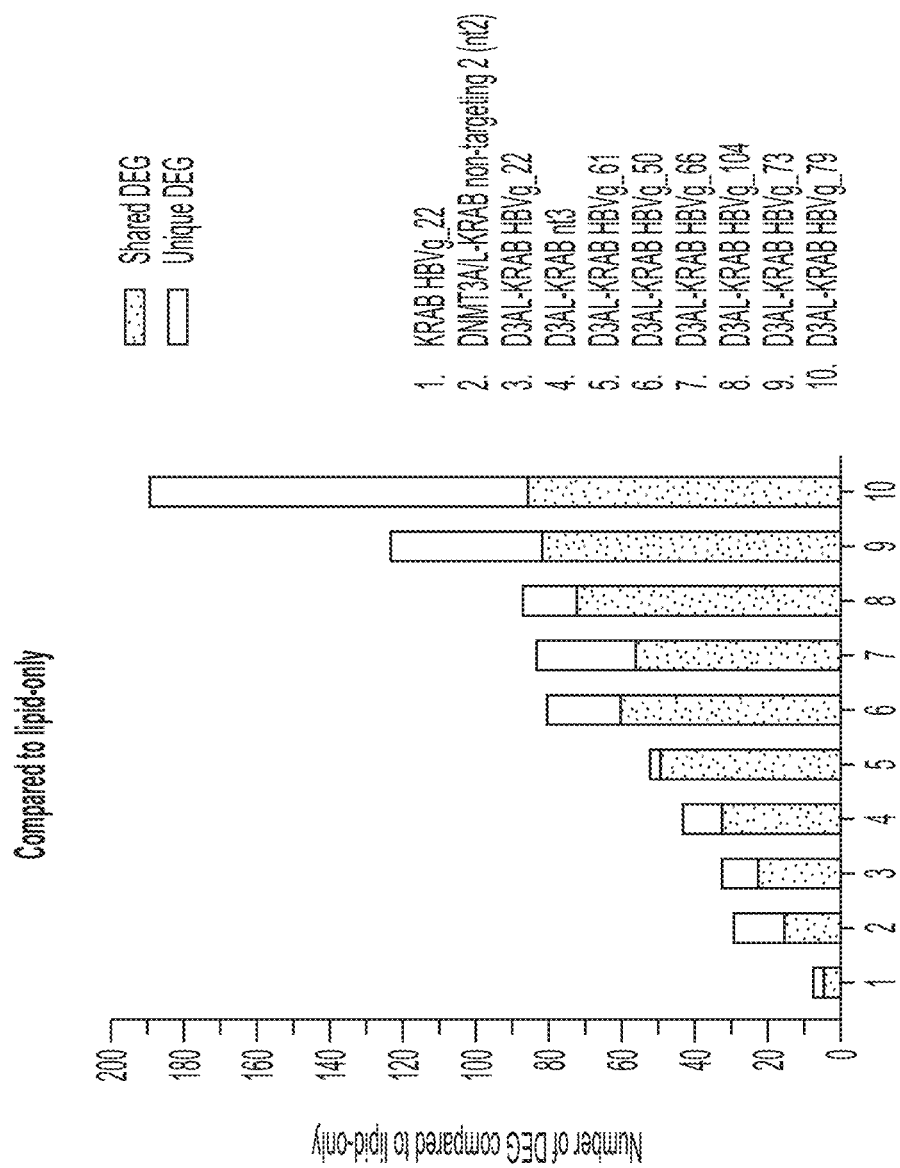
FIG. 23C shows minimal changes in differentially expressed genes mediated by gRNAs compared to lipid only control.
Figure 23D:
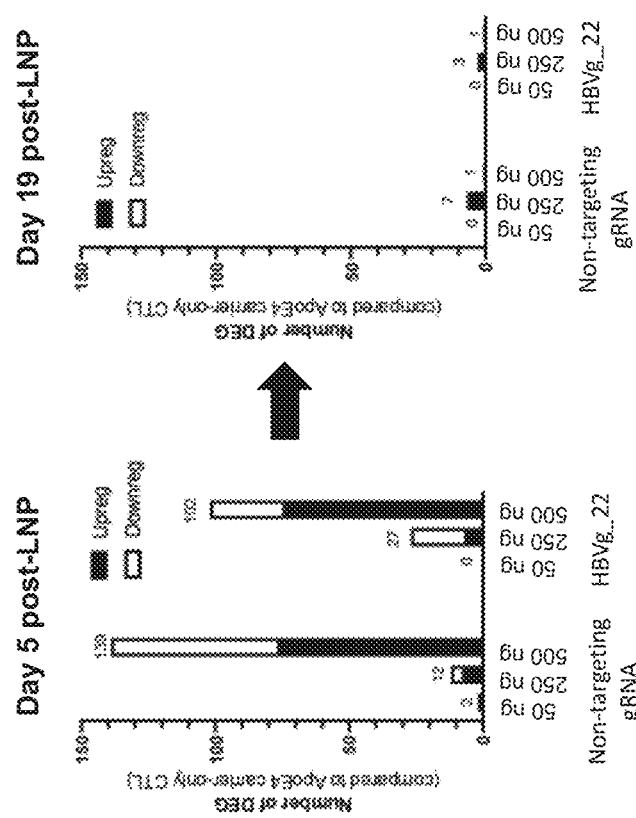
FIG. 23D shows no differentially expressed genes between non-targeting gRNA and HBVg_22 (SEQ ID NO: 412) at any dosage or timepoint.

Following lipofection of various HBV targeting gRNAs and mRNA at the maximum dose in HepG2.NTCP cells without viral infection, RNA sequencing was performed to assess differential changes to gene expression in non-targeted regions. FIG. 23A depicts a comparison of the epi-editor DNMT3A/L-dSpCas9-KRAB fusion (SEQ ID NO: 645) with targeting gRNAs versus epi-editor DNMT3A/L-dSpCas9-KRAB fusion (SEQ ID NO: 645) with non-targeting gRNAs. The results show no significantly altered gene expression relative to control non-targeting gRNA as a result of the gRNA HBVg_22 (SEQ ID NO: 412) three days post lipofection. FIG. 23B depicts a comparison of the epi-methylation-mediated effects by comparing differentially expressed transcripts following delivery of HBVg_22 (SEQ ID NO: 412) with either an mRNA encoding D3AL-K (SEQ ID NO: 644) or without the DNMT3A/3L domain (dCas9-KRAB, SEQ ID NO: 594), showing effectively no D3AL-mediated changes to gene expression. FIG. 23C shows minimal changes in differentially-expressed genes (DEG) mediated by the gRNAs three days post-lipofection. Most observed changes were shared across more than one gRNA ("Shared DEG") and were usually transient cell responses to RNA delivery and innate immune response related genes. A majority of the candidate gRNAs analyzed imparted minimal to no off-target differential expression with similarly low levels of off-target gene expression compared to that of a non-targeting gRNA. Additionally, LNPs encapsulating an mRNA encoding DNMT3A/L-dCas9-KRAB along with either HBVg_22 (SEQ ID NO: 412) or a non-targeting gRNA were delivered to primary human hepatocytes at 3 different levels (50 ng, 250 ng, 500 ng per well in a 24 well-plate). Following delivery of these LNPs, RNA was harvested from PHHs at Day 5 and Day 19 post-lipofection and RNA-sequencing was performed. These results showed no differentially expressed genes ([FDR<0.01, abs(L2FC) >1]) between non-targeting gRNA and HBVg_22 (SEQ ID NO: 412) at any dosage or timepoint (FIG. 23D). Very few transcriptional changes were seen relative to carrier-only PHH-HBVg_22 (SEQ ID NO: 412) performs similar to non-targeting control gRNA, and there was only one differentially-expressed gene remaining at Day 19 at the highest dosage.

Example 7: In Vivo Evaluation of HBV Repression in Human Chimeric Liver Mouse Study of HepB In this Example, a human chimeric liver mouse model (FRG) with high engraftment of human cells into the mouse liver was used. In this mouse model, mice were engrafted with human hepatocytes (more than 70% humanization) and then infected with HBV. The mouse model has several advantages including, presence of a true cccDNA with the native structure, human intracellular epigenetic machinery to interact with the epi-editor, a human genomic background, and reproduction of biologically relevant endpoints (HBV DNA, HBsAg, HBeAg) used in clinical trials.

Figure 24:
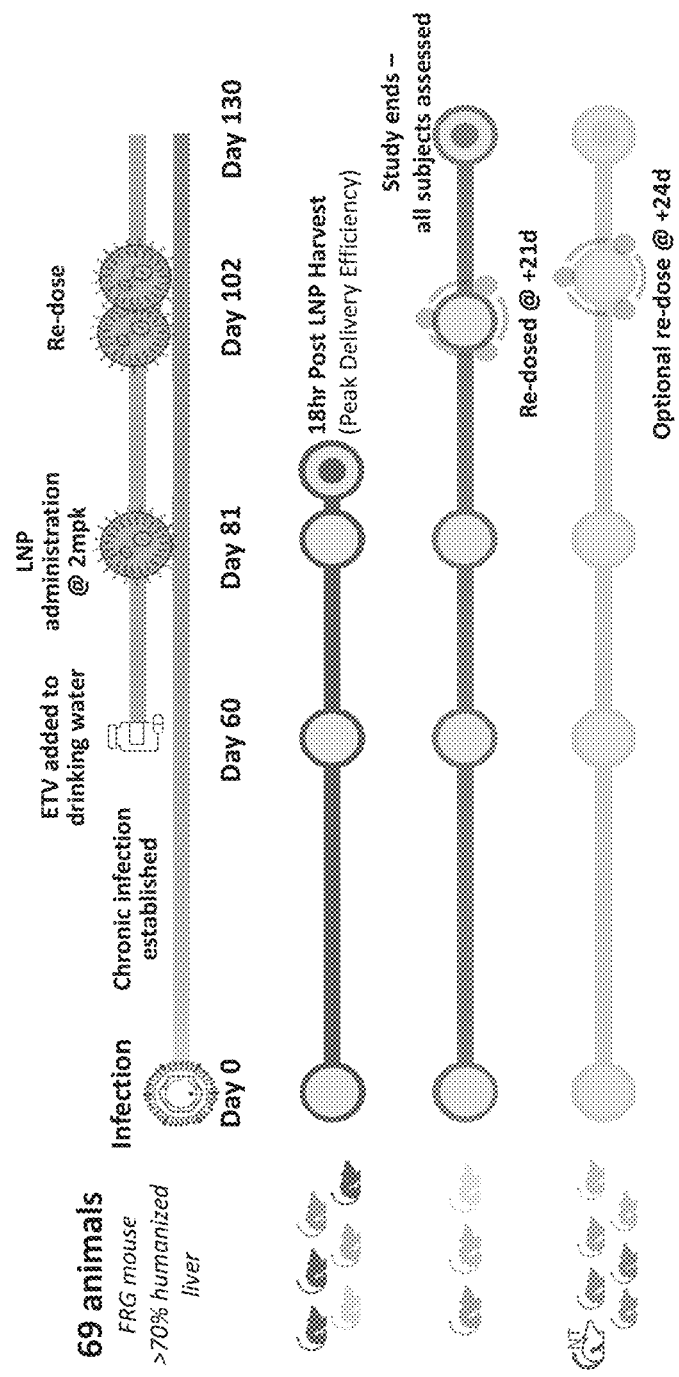
FIG. 24 shows a schematic representation of an in vivo study in human chimeric liver mice.

Mice were infected with approximately $1 \times 10^8$ HBV genomes via tail vein injections. As shown in FIG. 24, the viral infection was allowed to continue until a plateau phase of HBV DNA was reached (1-2 months post tail vein injection). The plateau phase is an indication that a chronic stabilized infection, comprising mostly cccDNA, with a very sparse degree of HBV integrations, has been established.

Once the chronic stabilized infection was established, the mice were dosed with standard of care treatment (e.g., nucleoside analog such as Entecavir, "ETV") with 1 µg/ml ETV added to drinking water. At day 81, the mice were administered either a) a combination of exemplary epi-editor mRNA with non-targeting gRNA or b) a combination of exemplary epi-editor mRNA and gRNA(s) targeting the HBV genome. The mice were dosed with a single gRNA or multiple gRNAs targeting the same or different genes in a multiplexed approach (as described in Example 4). Mice were grouped into cohorts and administered either 1) non-targeting gRNA (ntl) (n=9), 2) gRNA targeting HBx HBVg_22 (SEQ ID NO: 412) (n=9), 3) GalNAc-conjugated LNPs carrying gRNA HBVg_22 (SEQ ID NO: 412) (n=3), 4) gRNA targeting HBs HBVg_185 (SEQ ID NO: 575) (n=7), 5) gRNA HBVg_22 (SEQ ID NO: 412) and HBVg_185 (SEQ ID NO: 575) (n=7), 6) gRNA HBVg_73 (SEQ ID NO: 463) and 7) non targeting gRNA (ntl) (n=7), 8) gRNA HBVg_22 (SEQ ID NO: 412) (n=7). The combination of epi-editor mRNA (either DNMT3A/L-dCas9-KRAB (SEQ ID NO: 644) or dSpCas9-KRAB construct (SEQ ID NO: 594) for groups 7/8) and gRNAs were delivered at 2 milligrams per kilogram (mpk) doses via lipid nanoparticle delivery systems and RO injection, which allowed for delivery to only 50-60% of the human hepatocytes on average (as determined by protein immune-labeling). N-Acetylgalactosamine (GalNAc) conjugated-LNP in group 3) was administered to improve delivery of the LNP to the hepatocytes in the FRG mouse model. All subjects were assessed with serum draws as indicated and at the study endpoint (Day 130). The mice were evaluated for repression by monitoring the levels of HBV biomarkers, including HBV pre-genomic RNA (pgRNA), total HBV DNA in serum, HBeAg proteins in serum, and HbsAg proteins in serum. The changes in the levels of biomarkers were indicative of strong repression of viral replication and transcription to all cells delivered to in the human chimeric liver mouse. The mice may be further evaluated for effects of multiplexed repression on efficacy and durability, in vivo HBV methylation patterns, or on strength of repression after re-dosing.

A biodistribution mouse cohort (n=12) was harvested after 18 hours post administration to assess delivery efficiency across multiple delivery modalities. Prior to evaluating repression in the main cohort, a sentinel redosing cohort was redosed at either 1 mpk, 2 mpk, or 3 mpk to test tolerability. The mice were also redosed after 21 days or 24 days (approximately at day 102 of the mouse study).

Figure 25:
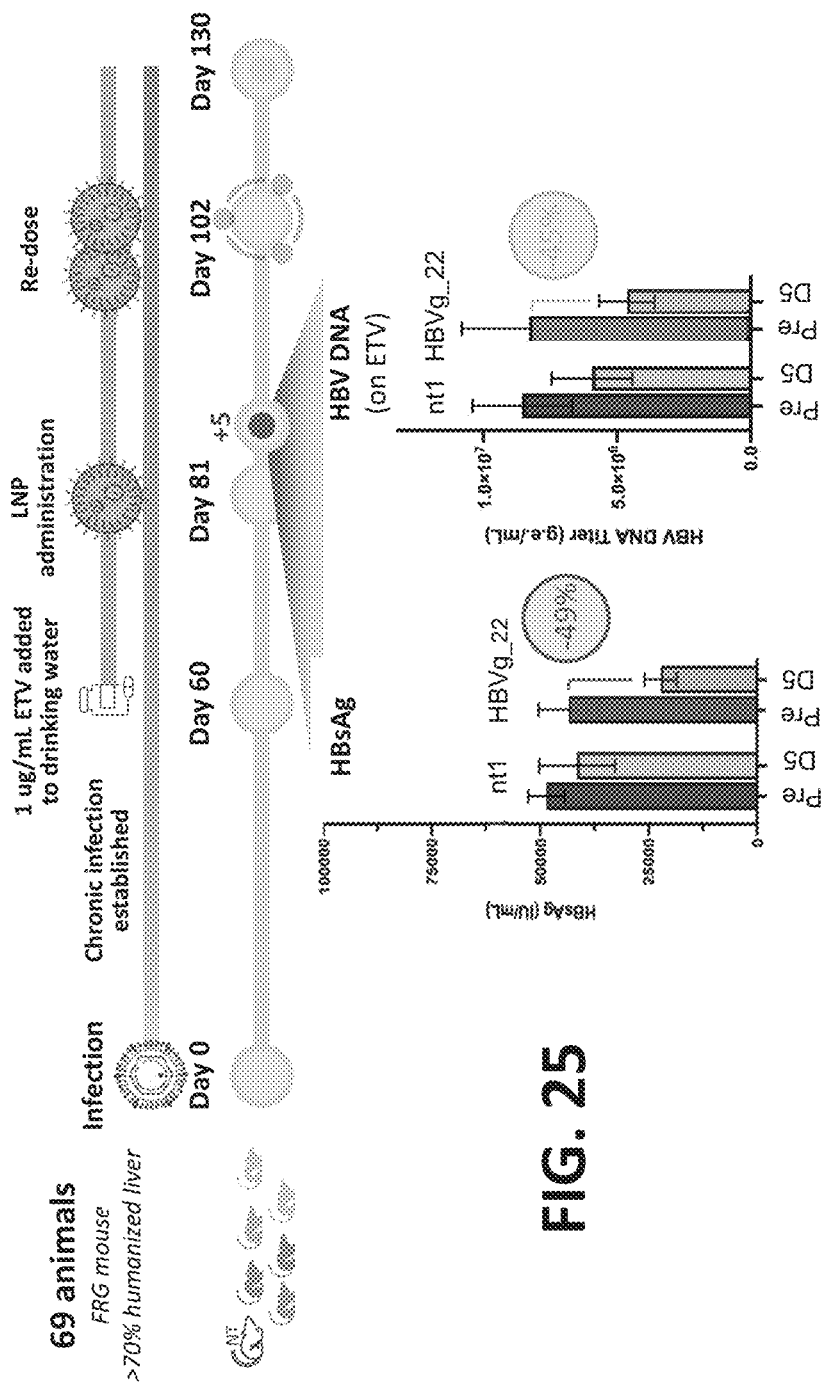
FIG. 25 shows repression mediated by an exemplary DNMT3A/L-dCas9-KRAB fusion protein combined with the gRNA HBVg_22 (SEQ ID NO: 412) five days (D5) after administration. Repression was measured by monitoring HBsAg protein levels and HBV DNA 2 days prior (pre dose) and five days after lipid nanoparticle administration (D5).

As shown in FIG. 25, approximately 50% repression of HBsAg and HBV DNA was seen with an exemplary gRNA HBVg_22 (SEQ ID NO: 412) five days post administration (Day 86). FIG. 26 shows fold change in the post-dose (day 5) to pre-dose (2 days prior) metric highlighting the levels of repression. These data represent strong evidence that the gRNA combined with the fusion protein induced near complete repression in vivo with native cccDNA. *=p<0.05, =p<0.01, and *=p<0.001 with students paired t-test)

Figure 27A:
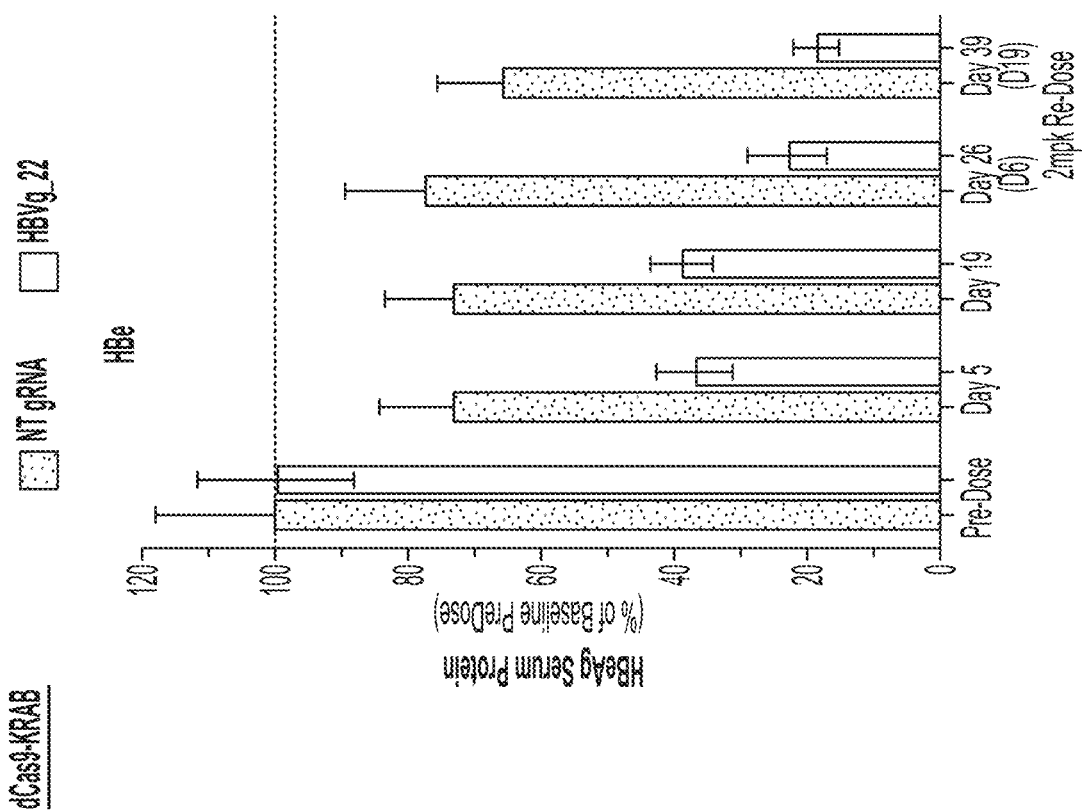
FIG. 27A-FIG. 27D show repression in FRG mice after redosing with HBVg_22 (SEQ ID NO: 412) either alone or multiplexed with HBVg_185 (SEQ ID NO: 575), or when delivered by LNP conjugated with GalNAc, in combination with either an mRNA encoding a dCas9-KRAB (FIG. 27A-27C) or DNMT3A/L-dCas9-KRAB (FIG. 27D).
Figures 27B, 27C:
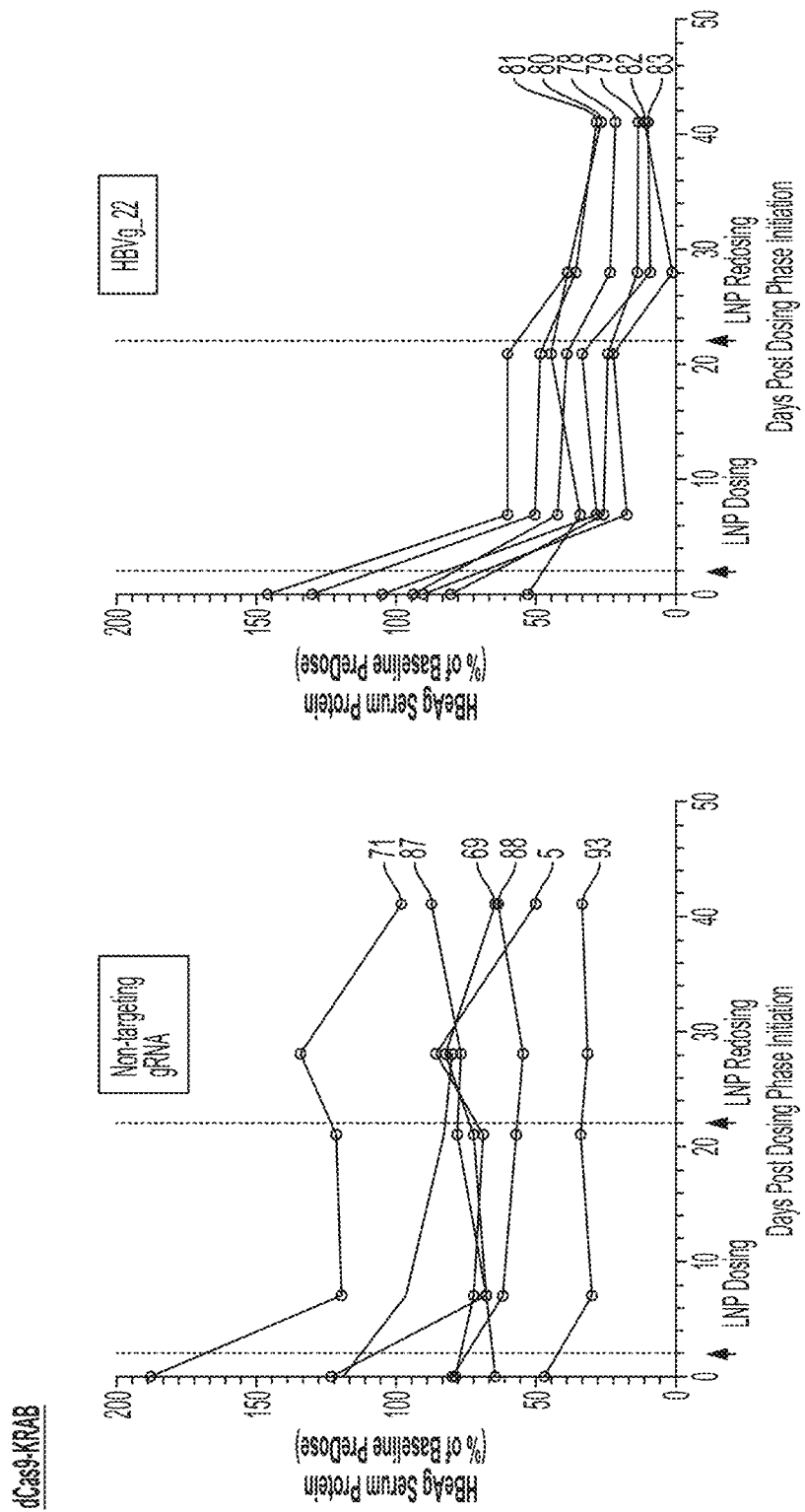
Figure 27D:
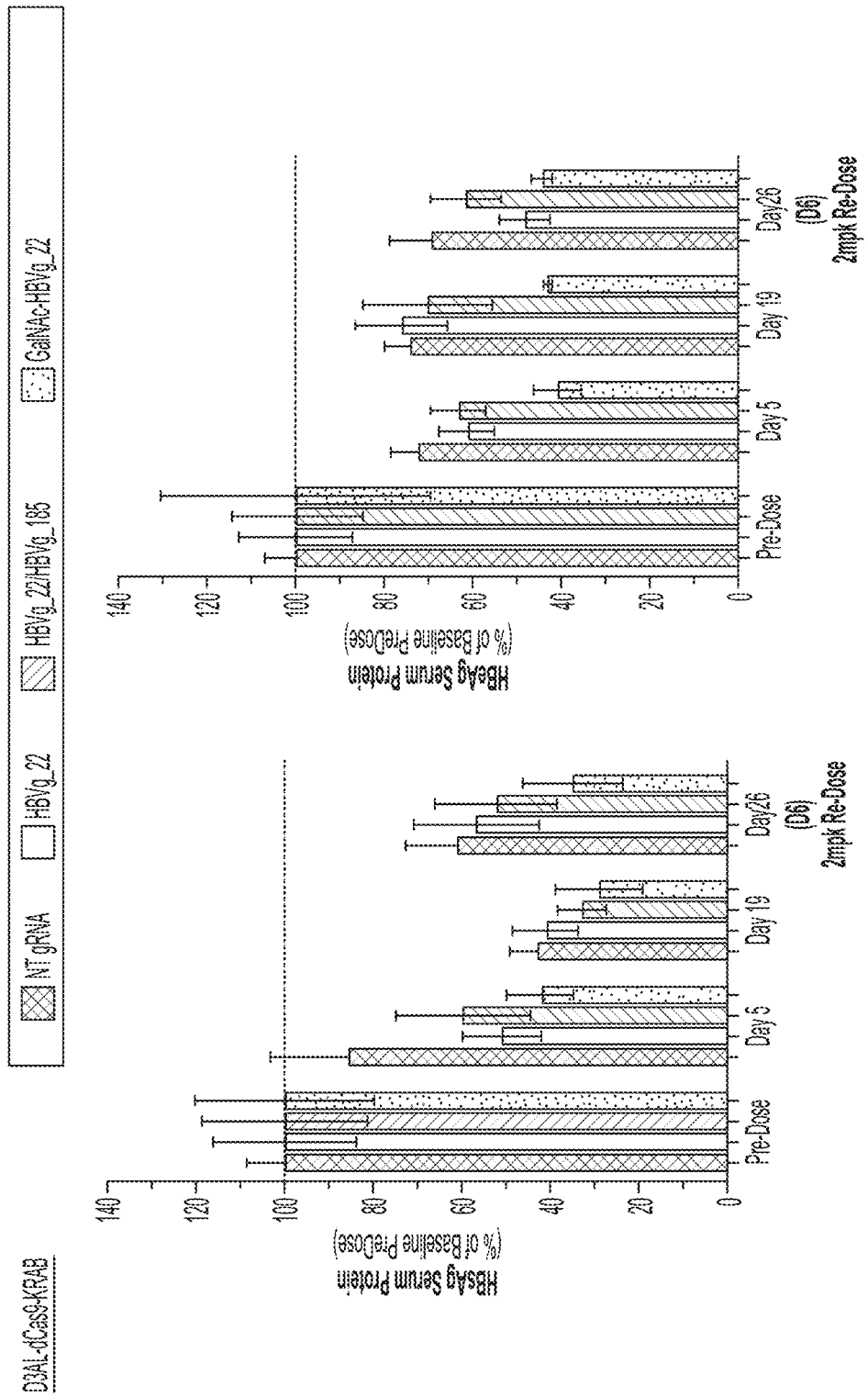

A redosing cohort was evaluated after redosing the mice with 2 mpk gRNA after 21 days from the start of the study outlined in FIG. 24. As shown in FIGS. 27A-27D, there was an improvement in repression after redosing with HBVg_22 (SEQ ID NO: 412) either alone or multiplexed with HBVg_185 (SEQ ID NO: 575), or when delivered by an LNP conjugated with GalNAc, in combination with either an mRNA encoding a dSpCas9-KRAB fusion protein (SEQ ID NO:594) (FIGS. 27A-C) or DNMT3A/L-dSpCas9-KRAB (FIG. 27D).

Figure 28A:
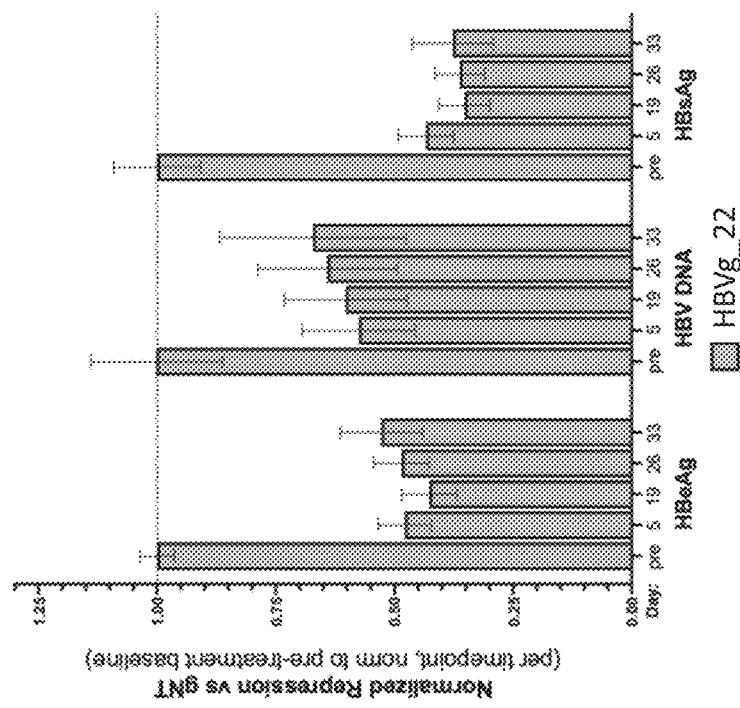
FIG. 28A-FIG. 28C show a human chimeric FRG mouse study following delivery by GalNAc conjugated PEG LNP.
Figure 28B:
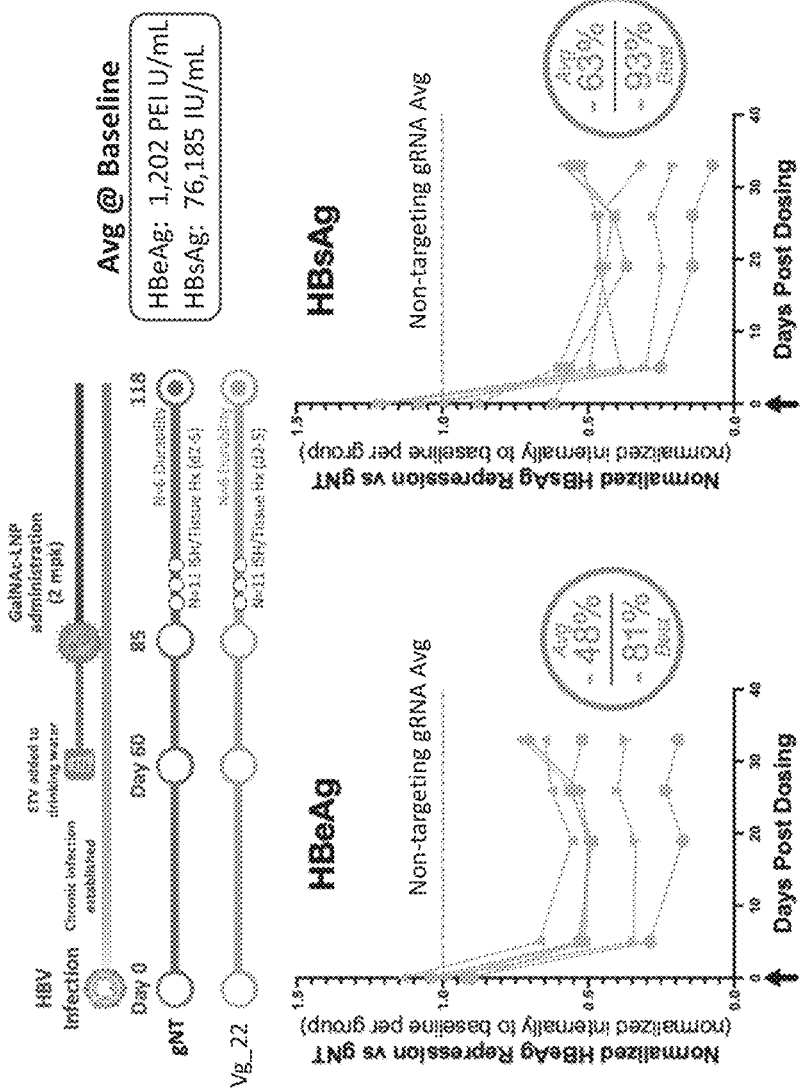
Figure 28C:
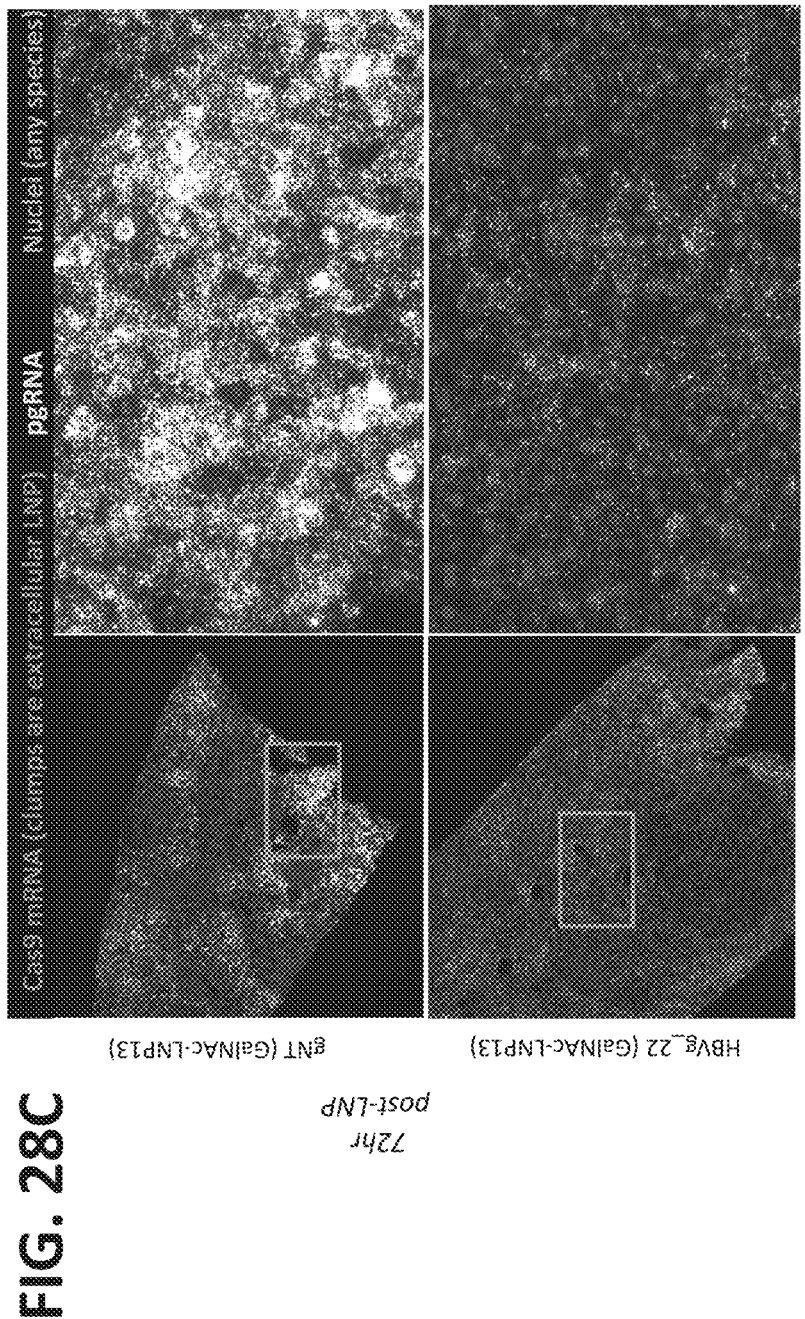

An additional human chimeric FRG mouse study was run with a similar chronic infection phase, followed by a similar ETV dosing phase prior to LNP administration. All LNPs used in this study were conjugated along with 0.15% molecular weight of GalNAc-PEG lipid to improve delivery in this chimeric mouse context. Following a single 2mpk RO injection of LNP containing either HBVg_22 (SEQ ID NO: 412) or a non-targeting gRNA along with an mRNA encoding DNMT3A/3L-dSpCas9-KRAB. Following this single dose, there was durable repression of serum HBeAg and HBsAg protein levels, as well similar reductions in serum HBV DNA levels out to Day 33 post LNP administration when compared to the non-targeting gRNA (FIG. 28A). Single mouse tracks of the degree of repression highlight the consistency of response seen across animals in these serum HBV protein metrics (FIG. 28B). Mice were harvested 72 hrs post LNP administration, tissues were fixed with formalin overnight, and samples were subjected to multi-channel RNAscope to show individual mRNA molecules in the cells (FIG. 28C). In regions with high Cas9 mRNA signal at this timepoint, we are able to see marked reductions in pgRNA signal in HBVg_22 (SEQ ID NO: 412)-delivered mice as compared to mice that received a non-targeting gRNA, with most remaining pgRNA signal being extracellular in the HBVg_22 (SEQ ID NO: 412) groups (FIG. 28A).

Example 8: Identification of Zinc Finger Proteins for Targeted Transcriptional Repression of Genes and Regulatory Elements Thereof Associated with Viral Replication and Transcription Engineered zinc finger proteins (eZFPs) were designed to bind to genes and regulatory elements of HBV associated with viral replication and transcription. Fusion proteins (eZFP-KRAB fusion proteins) comprising KRAB and one of 122 designed eZFPs were transduced into Hep3B cells to identify eZFPs with the highest transcriptional repression.

Figure 29A:
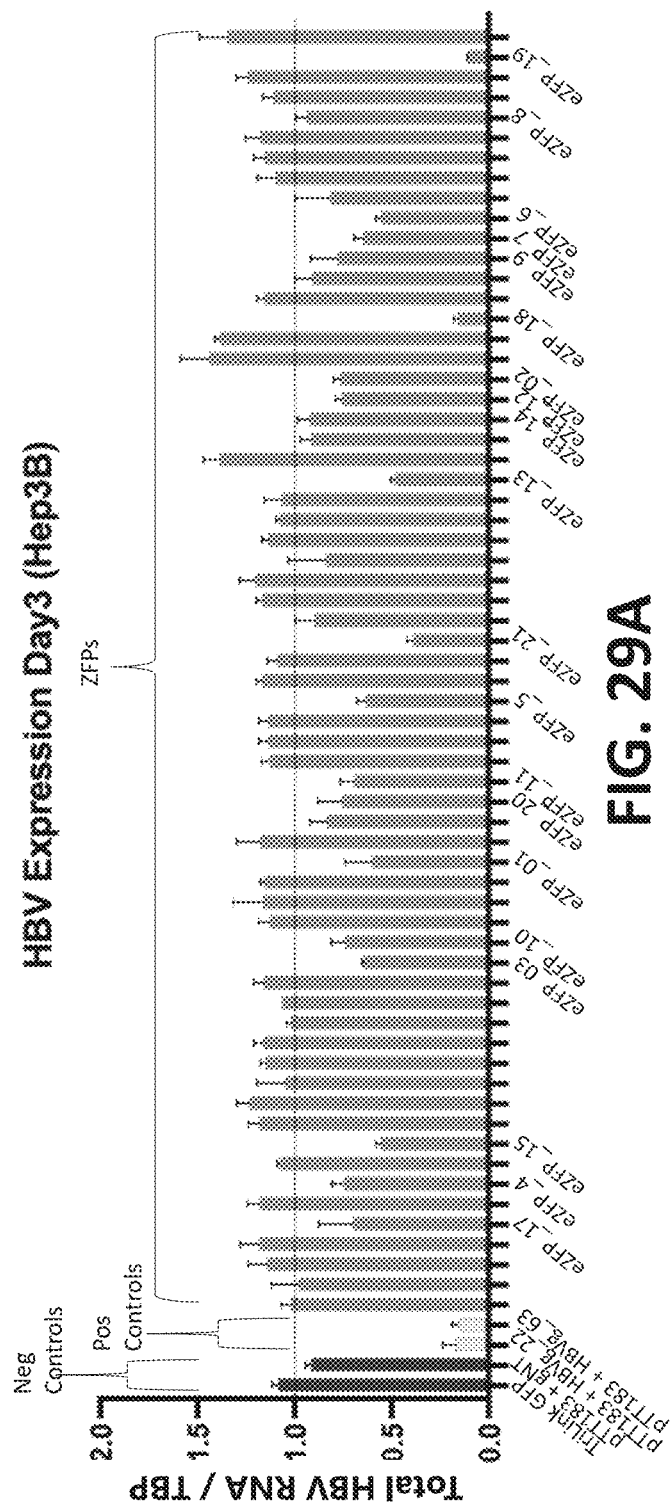
FIG. 29A-FIG. 29B depict the fold change in total HBV RNA mediated by each fusion protein comprising the KRAB epi-editor and a zinc finger protein (ZFP). The ZFP-KRAB fusion proteins were screened for HBV repression in Hep3B cells in two batches (FIG. 29A and FIG. 29B).
Figure 29B:
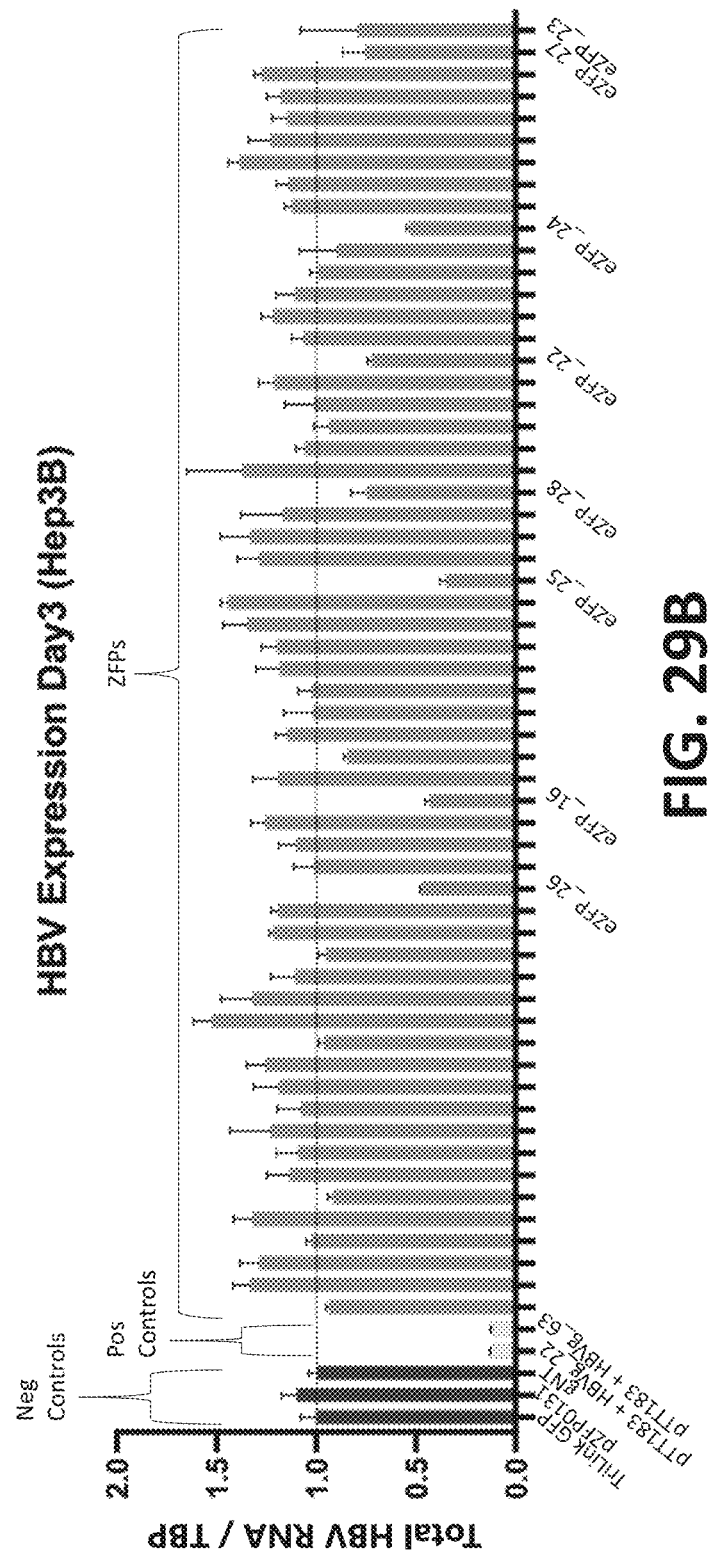

The eZFPs were designed as described in Section I-C. The mRNA encoding the fusion proteins was generated and transfected via lipofectamine into Hep3B cells in two batches (FIGS. 29A and 29B). The cells expressing the eZFP-KRAB fusion proteins (3×FLAG-SV40NLS-eZFP-SV40NLS-KRAB fusion proteins) were assessed by qPCR for HBV RNA levels after three days. The mRNA levels were compared to cells transfected with pTT183 (a dCas9-KRAB control) in combination with either HBVg_22 or HBVg_63. Negative controls included a TniLink GFP control, a non-targeting zinc finger protein pZFP0131 that does not bind any unique 18 bp sequence in the human genome, and non-targeting gRNA. Twenty-eight of the eZFP-KRAB fusion proteins screened led to decreased HBV mRNA levels in the Hep3B cells on Day 3 (FIGS. 29A and 29B; see also Table E4). These included the eZFP-KRAB fusion proteins set forth in SEQ ID NOs: 944-971 (Table E5), that targeted the target sites set forth in SEQ ID NOs: 1028-1055.

TABLE E4 eZFPs targeting genes and regulatory elements associated with HBV replication and transcription

| eZFP Name | Target Site Sequence | Recognition Regions F1-F6 | Amino Acid (AA) Sequence | AA Sequence SEQ ID NO: | exemplary nucleotide encoding sequence SEQ ID NO: |
|---|---|---|---|---|---|
| eZFP_1 | CAAGTGTTTGCTGACGCA (SEQ ID NO: 1028) | F1: SEADRSR (SEQ ID NO: 720)<br>F2: DRSNLTR (SEQ ID NO: 721)<br>F3: QSSDLSR (SEQ ID NO: 722)<br>F4: YHWYLKK (SEQ ID NO: 723)<br>F5: RSDSLSV (SEQ ID NO: 724)<br>F6: QNANRKT (SEQ ID NO: 725) | AAMAERPFQCRICMRNFSSEADRSRHIRTHTGEKPFACDICGRKFADRSNLTRHTKIHTGSQKPFQCRICMRNFSQSSDLSRHIRTHTGEKPFACDICGRKFAYHWYLKKHTKIHTGSQKPFQCRICMRNFSRSDSLSVHIRTHTGEKPFACDICGRKFAQNANRKTHTKIHLRQKDAAR | 692 | 888 |
| eZFP_2 | GGCTGGGGCTTGGTCATG (SEQ ID NO: 1029) | F1: RSDVLST (SEQ ID NO: 726)<br>F2: DNSSRTR (SEQ ID NO: 727)<br>F3: RPYTLRL (SEQ ID NO: 728)<br>F4: DSSHRTR (SEQ ID NO: 729)<br>F5: RSDHLSQ (SEQ ID NO: 730)<br>F6: DSSHRTR (SEQ ID NO: 731) | AAMAERPFQCRICMRNFSRSDVLSTHIRTHTGEKPFACDICGKKFADNSSRTRHTKIHTGSQKPFQCRICMRNFSRPYTLRLHIRTHTGEKPFACDICGRKFADSSHRTRHTKIHTGSQKPFQCRICMRNFSRSDHLSQHIRTHTGEKPFACDICGRKFADSSHRTRHTKIHLRQKDAAR | 693 | 889 |
| eZFP_3 | GCTGGGGCTTGGTCATGG (SEQ ID NO: 1030) | F1: RSDHLSQ (SEQ ID NO: 732)<br>F2: QSADRTK (SEQ ID NO: 733)<br>F3: RSDHLSQ (SEQ ID NO: 734)<br>F4: RRSDLKR (SEQ ID NO: 735)<br>F5: RSDHLSR (SEQ ID NO: 736)<br>F6: QSSDLRR (SEQ ID NO: 737) | AAMAERPFQCRICMRNFSRSDHLSQHIRTHTGEKPFACDICGRKFAQSADRTKHTKIHTGSQKPFQCRICMRNFSRSDHLSQHIRTHTGEKPFACDICGRKFARRSDLKRHTKIHTGSQKPFQCRICMRNFSRSDHLSRHIRTHTGEKPFACDICGRKFAQSSDLRRHTKIHLRQKDAAR | 694 | 890 |
| eZFP_4 | TTGGTCATGGGCCATCAG (SEQ ID NO: 1031) | F1: RSDNLSE (SEQ ID NO: 738)<br>F2: TSSNRKT (SEQ ID NO: 739)<br>F3: DRSHLTR (SEQ ID NO: 740)<br>F4: RSDALTQ (SEQ ID NO: 741)<br>F5: DRSALAR (SEQ ID NO: 742)<br>F6: RRFTLSK (SEQ ID NO: 743) | AAMAERPFQCRICMRNFSRSDNLSEHIRTHTGEKPFACDICGRKFATSSNRKTHTKIHTGSQKPFQCRICMRNFSDRSHLTRHIRTHTGEKPFACDICGRKFARSDALTQHTKIHTGSQKPFQCRICMRNFSDRSALARHIRTHTGEKPFACDICGRKFARRFTLSKHTKIHLRQKDAAR | 695 | 891 |
| eZFP_5 | TGCGTGGAACCTTTTCGG (SEQ ID NO: 1032) | F1: RSDHLSE (SEQ ID NO: 744)<br>F2: QYSGRYY (SEQ ID NO: 745)<br>F3: HGQTLNE (SEQ ID NO: 746)<br>F4: QSGNLAR (SEQ ID NO: 747)<br>F5: RSDSLLR (SEQ ID NO: 748)<br>F6: CREYRGK (SEQ ID NO: 749) | AAMAERPFQCRICMRNFSRSDHLSEHIRTHTGEKPFACDICGRKFAQYSGRYYHTKIHTGSQKPFQCRICMRNFSHGQTLNEHIRTHTGEKPFACDICGRKFAQSGNLARHTKIHTGSQKPFQCRICMRNFSRSDSLLRHIRTHTGEKPFACDICGRKFACREYRGKHTKIHLRQKDAAR | 696 | 892 |

TABLE E4-continued eZFPs targeting genes and regulatory elements associated with HBV replication and transcription

| eZFP Name | Target Site Sequence | Recognition Regions F1-F6 | Amino Acid (AA) Sequence | AA Sequence SEQ ID NO: | exemplary nucleotide encoding sequence SEQ ID NO: |
|---|---|---|---|---|---|
| eZFP_6 | GCAGCAGGTCTGGAGCAA (SEQ ID NO: 1033) | F1: QSANRTT (SEQ ID NO: 750) F2: RSANLTR (SEQ ID NO: 751) F3: RSDVLSE (SEQ ID NO: 752) F4: TSGHLSR (SEQ ID NO: 753) F5: QSSDLSR (SEQ ID NO: 754) F6: QWSTRKR (SEQ ID NO: 755) | AAMAERPFQCRICMRNFSQSANRTTHIRTHTGEKPFACDICGRKFARSANLTRHTKIHTGSQKPFQCRICMRNFSRSDVLSEHIRTHTGEKPFACDICGRKFATSGHLSRHTKIHTGSQKPFQCRICMRNFSQSSDLSRHIRTHTGEKPFACDICGRKFAQWSTRKRHTKIHLRQKDAAR | 697 | 893 |
| eZFP_7 | CAGCAGGTCTGGAGCAAA (SEQ ID NO: 1034) | F1: QSGNLAR (SEQ ID NO: 756) F2: ATCCLAH (SEQ ID NO: 757) F3: RWQYLPT (SEQ ID NO: 758) F4: DRSALAR (SEQ ID NO: 759) F5: RSDNLSE (SEQ ID NO: 760) F6: KRCNLRC (SEQ ID NO: 761) | AAMAERPFQCRICMRNFSQSGNLARHIRTHTGEKPFACDICGRKFAATCCLAHHTKIHTGSQKPFQCRICMRNFSRWQYLPTHIRTHAGEKPFACDICGRKFADRSALARHTKIHTGSQKPFQCRICMRNFSRSDNLSEHIRTHTGEKPFACDICGRKFAKRCNLRCHTKIHLRQKDAAR | 698 | 894 |
| eZFP_8 | AGCAGGTCTGGAGCAAAC (SEQ ID NO: 1035) | F1: NPANLTR (SEQ ID NO: 762) F2: QNATRTK (SEQ ID NO: 763) F3: QSGHLAR (SEQ ID NO: 764) F4: NRHDRAK (SEQ ID NO: 765) F5: RSDHLSE (SEQ ID NO: 766) F6: QRRSRYK (SEQ ID NO: 767) | AAMAERPFQCRICMRNFSNPANLTRHIRTHTGEKPFACDICGRKFAQNATRTKHTKIHTGSQKPFQCRICMRNFSQSGHLARHIRTHTGEKPFACDICGRKFANRHDRAKHTKIHTGSQKPFQCRICMRNFSRSDHLSEHIRTHTGEKPFACDICGRKFAQRRSRYKHTKIHLRQKDAAR | 699 | 895 |
| eZFP_9 | ATCGTATCCATGGCTGCT (SEQ ID NO: 1036) | F1: QSSDLSR (SEQ ID NO: 768) F2: HRSTRNR (SEQ ID NO: 769) F3: RSDVLSA (SEQ ID NO: 770) F4: DSRTRKN (SEQ ID NO: 771) F5: QSGSLTR (SEQ ID NO: 772) F6: DQSGLAH (SEQ ID NO: 773) | AAMAERPFQCRICMRNFSQSSDLSRHIRTHTGEKPFACDICGRKFAHRSTRNRHTKIHTGSQKPFQCRICMRNFSRSDVLSAHIRTHTGEKPFACDICGRKFADSRTRKNHTKIHTGSQKPFQCRICMRNFSQSGSLTRHIRTHTGEKPFACDICGRKFADQSGLAHHTKIHLRQKDAAR | 700 | 896 |
| eZFP_10 | CCAGTGGGGGTTGCGTCA (SEQ ID NO: 1037) | F1: QNPAQWR (SEQ ID NO: 774) F2: RSADLSR (SEQ ID NO: 775) F3: TSGSLSR (SEQ ID NO: 776) F4: RSDHLSR (SEQ ID NO: 777) F5: RSDSLLR (SEQ ID NO: 778) F6: QSYDRFQ (SEQ ID NO: 779) | AAMAERPFQCRICMRNFSQNPAQWRHIRTHTGEKPFACDICGRKFARSADLSRHTKIHTGSQKPFQCRICMRNFSTGSLSRHIRTHTGEKPFACDICGRKFARSDHLSRHTKIHTGSQKPFQCRICMRNFSRSDSLLRHIRTHTGEKPFACDICGRKFAQSYDRFQHTKIHLRQKDAAR | 701 | 897 |

TABLE E4-continued eZFPs targeting genes and regulatory elements associated with HBV replication and transcription

| eZFP Name | Target Site Sequence | Recognition Regions F1-F6 | Amino Acid (AA) Sequence | AA Sequence SEQ ID NO: | exemplary nucleotide encoding sequence SEQ ID NO: |
|---|---|---|---|---|---|
| eZFP_11 | CCCCAGCCAGTGGGGGTT (SEQ ID NO: 1038) | F1: TSGSLSR (SEQ ID NO: 780)<br>F2: RSDHLSR (SEQ ID NO: 781)<br>F3: RSDSLL (SEQ ID NO: 782)<br>F4: QSYDRFQ (SEQ ID NO: 783)<br>F5: RSDNLST (SEQ ID NO: 784)<br>F6: DNRDRIK (SEQ ID NO: 785) | AAMAERPFQCRICMRNFSTSGSLSRHIRTHTGEKPFACDICGRKFARSDHLSRHTKIHTGSQKPFQCRICMRNFSRSDSLLRHIRTHTGEKPFACDICGRKFAQSYDRFQHTKIHTGSQKPFQCRICMRNFSRSDNLSTHIRTHTGEKPFACDICGRKFADNRDRIKHTKIHLRQKDAAR | 702 | 898 |
| eZFP_12 | GCGCTGATGGCCCATGAC (SEQ ID NO: 1039) | F1: DRSNLSR (SEQ ID NO: 786)<br>F2: LRQNLIM (SEQ ID NO: 787)<br>F3: ERGTLAR (SEQ ID NO: 788)<br>F4: RSDALTQ (SEQ ID NO: 789)<br>F5: RSDSLSQ (SEQ ID NO: 790)<br>F6: RKADRTR (SEQ ID NO: 791) | AAMAERPFQCRICMRNFSDRSNLSRHIRTHTGEKPFACDICGRKFALRQNLIMHTKIHTGSQKPFQCRICMRNFSERGTLARHIRTHTGEKPFACDICGRKFARSDALTQHTKIHTGSQKPFQCRICMRNFSRSDSLSQHIRTHTGEKPFACDICGRKFARKADRTRHTKIHLRQKDAAR | 703 | 899 |
| eZFP_13 | CACGCACGCGCTGATGGC (SEQ ID NO: 1040) | F1: QYCCLTN (SEQ ID NO: 792)<br>F2: TSGNLTR (SEQ ID NO: 793)<br>F3: QSSDLSR (SEQ ID NO: 794)<br>F4: FRYYLKR (SEQ ID NO: 795)<br>F5: QSGDLTR (SEQ ID NO: 796)<br>F6: DKGNLTK (SEQ ID NO: 797) | AAMAERPFQCRICMRNFSQYCCLTNHIRTHTGEKPFACDICGRKFATSGNLTRHTKIHTGSQKPFQCRICMRNFSQSSDLSRHIRTHTGEKPFACDICGRKFAFRYYLKRHTKIHTGSQKPFQCRICMRNFSQSGDLTRHIRTHTGEKPFACDICGRKFADKGNLTKHTKIHLRQKDAAR | 704 | 900 |
| eZFP_14 | AGAGGAGCCGAAAAGGTT (SEQ ID NO: 1041) | F1: TSGSLSR (SEQ ID NO: 798)<br>F2: RSDNLTT (SEQ ID NO: 799)<br>F3: QSGNLAR (SEQ ID NO: 800)<br>F4: DRTTLMR (SEQ ID NO: 801)<br>F5: QSGHLAR (SEQ ID NO: 802)<br>F6: QLTHLNS (SEQ ID NO: 803) | AAMAERPFQCRICMRNFSTSGSLSRHIRTHTGEKPFACDICGRKFARSDNLTTHTKIHTGSQKPFQCRICMRNFSQSGNLARHIRTHTGEKPFACDICGRKFADRTTLMRHTKIHTGSQKPFQCRICMRNFSQSGHLARHIRTHTGEKPFACDICGRKFAQLTHLNSHTKIHLRQKDAAR | 705 | 901 |
| eZFP_15 | GGATCGGCAGAGGAGCCG (SEQ ID NO: 1042) | F1: IKHDLHR (SEQ ID NO: 804)<br>F2: RSANLTR (SEQ ID NO: 805)<br>F3: RSDNLAR (SEQ ID NO: 806)<br>F4: QNVSRPR (SEQ ID NO: 807)<br>F5: RSDDLSK (SEQ ID NO: 808)<br>F6: DSSHRTR (SEQ ID NO: 809) | AAMAERPFQCRICMRNFSIKHDLHRHIRTHTGEKPFACDICGRKFARSANLTRHTKIHTGSQKPFQCRICMRNFSRSDNLARHIRTHTGEKPFACDICGRKFAQNVSRPRHTKIHTGSQKPFQCRICMRNFSRSDDLSKHIRTHTGEKPFACDICGRKFADSSHRTRHTKIHLRQKDAAR | 706 | 902 |

TABLE E4-continued eZFPs targeting genes and regulatory elements associated with HBV replication and transcription

| eZFP Name | Target Site Sequence | Recognition Regions F1-F6 | Amino Acid (AA) Sequence | AA Sequence SEQ ID NO: | exemplary nucleotide encoding sequence SEQ ID NO: |
|---|---|---|---|---|---|
| eZFP_16 | CAGTATGGATCGGCAGAG (SEQ ID NO: 1043) | F1: RSDNLAR (SEQ ID NO: 810) F2: QNVSRPR (SEQ ID NO: 811) F3: RSDDLSK (SEQ ID NO: 812) F4: DSSHRTR (SEQ ID NO: 813) F5: TSSNRKT (SEQ ID NO: 814) F6: AQWTRAC (SEQ ID NO: 815) | AAMAERPFQCRICMRNFSRSDNLARHIRTHTGEKPFACDICGRKFAQNVSRPRHTKIHTGSQKPFQCRICMRNFSRSDDLSKHIRTHTGEKPFACDICGRKFADSSHRTRHTKIHTGSQKPFQCRICMRNFSTSSNRKTHIRTHTGEKPFACDICGRKFAAQWTRACHTKIHLRQKDAAR | 707 | 903 |
| eZFP_17 | GTTCCGCAGTATGGATCG (SEQ ID NO: 1044) | F1: RSDDLSK (SEQ ID NO: 816) F2: DSSHRTR (SEQ ID NO: 817) F3: TSSNRKT (SEQ ID NO: 818) F4: AQWTRAC (SEQ ID NO: 819) F5: RKQTRTT (SEQ ID NO: 820) F6: HRSSLRR (SEQ ID NO: 821) | AAMAERPFQCRICMRNFSRSDDLSKHIRTHTGEKPFACDICGRKFADSSHRTRHTKIHTGSQKPFQCRICMRNFSTSSNRKTHIRTHTGEKPFACDICGRKFAAQWTRACHTKIHTGSQKPFQCRICMRNFSRKQTRTTHIRTHTGEKPFACDICGRKFAHRSSLRRHTKIHLRQKDAAR | 708 | 904 |
| eZFP_18 | GGAGTTCCGCAGTATGGA (SEQ ID NO: 1045) | F1: QSAHRKN (SEQ ID NO: 822) F2: TSSNRKT (SEQ ID NO: 823) F3: RSDNLSA (SEQ ID NO: 824) F4: RNNDRKT (SEQ ID NO: 825) F5: TSGSLSR (SEQ ID NO: 826) F6: QAGHLAK (SEQ ID NO: 827) | AAMAERPFQCRICMRNFSQSAHRKNHIRTHTGEKPFACDICGRKFATSSNRKTHTKIHTGSQKPFQCRICMRNFSRSDNLSAHIRTHTGEKPFACDICGRKFARNNDRKTHTKIHTGSQKPFQCRICMRNFSTSGSLSRHIRTHTGEKPFACDICGRKFAQAGHLAKHTKIHLRQKDAAR | 709 | 905 |
| eZFP_19 | GCAAAACAAGCGGCTAGG (SEQ ID NO: 1046) | F1: RSDHLSQ (SEQ ID NO: 828) F2: ASSTRTK (SEQ ID NO: 829) F3: RSDDLTR (SEQ ID NO: 830) F4: QKSNLSS (SEQ ID NO: 831) F5: QSANRTT (SEQ ID NO: 832) F6: QNATRTK (SEQ ID NO: 833) | AAMAERPFQCRICMRNFSRSDHLSQHIRTHTGEKPFACDICGRKFAASSTRTKHTKIHTGSQKPFQCRICMRNFSRSDDLTRHIRTHTGEKPFACDICGRKFAQKSNLSSHTKIHTGSQKPFQCRICMRNFSQSANRTTHIRTHTGEKPFACDICGRKFAQNATRTKHTKIHLRQKDAAR | 710 | 906 |
| eZFP_20 | TTTGCTCCAGACCTGCTG (SEQ ID NO: 1047) | F1: RSDTLSE (SEQ ID NO: 834) F2: RRWTLVG (SEQ ID NO: 835) F3: DRSNLSR (SEQ ID NO: 836) F4: QSGDLTR (SEQ ID NO: 837) F5: QSSDLSR (SEQ ID NO: 838) F6: YHWYLKK (SEQ ID NO: 839) | AAMAERPFQCRICMRNFSRSDTLSEHIRTHTGEKPFACDICGRKFARRWTLVGHTKIHTGSQKPFQCRICMRNFSDRSNLSRHIRTHTGEKPFACDICGRKFAQSGDLTRHTKIHTGSQKPFQCRICMRNFSQSSDLSRHIRTHTGEKPFACDICGRKFAYHWYLKKHTKIHLRQKDAAR | 711 | 907 |

TABLE E4-continued eZFPs targeting genes and regulatory elements associated with HBV replication and transcription

| eZFP Name | Target Site Sequence | Recognition Regions F1-F6 | Amino Acid (AA) Sequence | AA Sequence SEQ ID NO: | exemplary nucleotide encoding sequence SEQ ID NO: |
|---|---|---|---|---|---|
| eZFP_21 | GATGTATATTTGCGGGAG (SEQ ID NO: 1048) | F1: RSANLAR (SEQ ID NO: 840) F2: RSDNLRE (SEQ ID NO: 841) F3: RPYTLRL (SEQ ID NO: 842) F4: HRSNLNK (SEQ ID NO: 843) F5: QSGSLTR (SEQ ID NO: 844) F6: TSANLSR (SEQ ID NO: 845) | AAMAERPFQCRICMRNFSRSANLARHIRTHTGEKPFACDICGRKFARSDNLREHTKIHTGSQKPFQCRICMRNFSRPYTLRLHIRTHTGEKPFACDICGRKFAHRSNLNKHTKIHTGSQKPFQCRICMRNFSQSGSLTRHIRTHTGEKPFACDICGRKFATSANLSRHTKIHLRQKDAAR | 712 | 908 |
| eZFP_22 | CAGCCAGTGGGGGTTGCG (SEQ ID NO: 1049) | F1: RSDDLVR (SEQ ID NO: 846) F2: TSGSLVR (SEQ ID NO: 847) F3: RSDKLVR (SEQ ID NO: 848) F4: RSDELVR (SEQ ID NO: 849) F5: TSHSLTE (SEQ ID NO: 850) F6: RADNLTE (SEQ ID NO: 851) | LEPGEKPYACPECGKSFSRSDDLVRHQRTHTGEKPYKCPECGKSFSTSGSLVRHQRTHTGEKPYKCPECGKSFSRSDKLVRHQRTHTGEKPYACPECGKSFSRSDELVRHQRTHTGEKPYKCPECGKSFSTSHSLTEHQRTHTGEKPYKCPECGKSFSRADNLTEHQRTHTGEKTS | 713 | 909 |
| eZFP_23 | GATGGCCCATGACCAAGC (SEQ ID NO: 1050) | F1: ERSHLRE (SEQ ID NO: 852) F2: TSHSLTE (SEQ ID NO: 853) F3: QAGHLAS (SEQ ID NO: 854) F4: TSHSLTE (SEQ ID NO: 855) F5: DPGHLVR (SEQ ID NO: 856) F6: TSGNLVR (SEQ ID NO: 857) | LEPGEKPYACPECGKSFSERSHLREHQRTHTGEKPYKCPECGKSFSTSHSLTEHQRTHTGEKPYKCPECGKSFSQAGHLASHQRTHTGEKPYACPECGKSFSTSHSLTEHQRTHTGEKPYKCPECGKSFSDPGHLVRHQRTHTGEKPYKCPECGKSFSTSGNLVRHQRTHTGKKTS | 714 | 910 |
| eZFP_24 | GGGGTAAAGGTTCAGGTA (SEQ ID NO: 1051) | F1: RADNLTE (SEQ ID NO: 858) F2: TSGSLVR (SEQ ID NO: 859) F3: RKDNLKN (SEQ ID NO: 860) F4: QSSSLVR (SEQ ID NO: 861) F5: RSDKLVR (SEQ ID NO: 862) F6: DSGNLRV (SEQ ID NO: 863) | LEPGEKPYKCPECGKSFSRADNLTEHQRTHTGEKPYKCPECGKSFSTSGSLVRHQRTHTGEKPYKCPECGKSFSRKDNLKNHQRTHTGEKPYKCPECGKSFSQSSSLVRHQRTHTGEKPYKCPECGKSFSRSDKLVRHQRTHTGEKPYKCPECGKSFSDSGNLRVHQRTHTGKKTS | 715 | 911 |
| eZFP_25 | GCTAGGAGTTCCGCAGTA (SEQ ID NO: 1052) | F1: QSSSLVR (SEQ ID NO: 864) F2: QSGDLRR (SEQ ID NO: 865) F3: RSDERKR (SEQ ID NO: 866) F4: HRTTLTN (SEQ ID NO: 867) F5: RSDHLTN (SEQ ID NO: 868) F6: TSGELVR (SEQ ID NO: 869) | LEPGEKPYACPECGKSFSQSSSLVRHQRTHTGEKPYKCPECGKSFSQSGDLRRHQRTHTGEKPYKCPECGKSFSRSDERKRHQRTHTGEKPYACPECGKSFSHRTTLTNHQRTHTGEKPYKCPECGKSFSRSDHLTNHQRTHTGEKPYKCPECGKSFSTSGELVRHQRTHTGKKTS | 716 | 912 |

TABLE E4-continued eZFPs targeting genes and regulatory elements associated with HBV replication and transcription

| eZFP Name | Target Site Sequence | Recognition Regions F1-F6 | Amino Acid (AA) Sequence | AA Sequence SEQ ID NO: | exemplary nucleotide encoding sequence SEQ ID NO: |
|---|---|---|---|---|---|
| eZFP_26 | GCGGC TAGGA GTTCC GCA (SEQ ID NO: 1053) | F1: QSGDLRR (SEQ ID NO: 870) F2: RSDERKR (SEQ ID NO: 871) F3: HRTTLTN (SEQ ID NO: 872) F4: RSDHLTN (SEQ ID NO: 873) F5: TSGELVR (SEQ ID NO: 874) F6: RSDDLVR (SEQ ID NO: 875) | LEPGEKPYACPECGKSFSQS GDLRRHQRTHTGEKPYKCP ECGKSFSRSDERKRHQRTH TGEKPYKCPECGKSFSHRT TLTNHQRTHTGEKPYACPE CGKSFSRSDHLTNHQRTHT GEKPYKCPECGKSFSTSGEL VRHQRTHTGEKPYKCPECG KSFSRSDDLVRHQRTHTGK KTS | 717 | 913 |
| eZFP_27 | GTATG GATCG GCAGA GGA (SEQ ID NO: 1054) | F1: QRAHLER (SEQ ID NO: 876) F2: QLAHLRA (SEQ ID NO: 877) F3: DPGHLVR (SEQ ID NO: 878) F4: RRSACRR (SEQ ID NO: 879) F5: RSDHLTT (SEQ ID NO: 880) F6: QSSSLVR (SEQ ID NO: 881) | LEPGEKPYACPECGKSFSQR AHLERHQRTHTGEKPYKCP ECGKSFSQLAHLRAHQRTH TGEKPYKCPECGKSFSDPG HLVRHQRTHTGEKPYACPE CGKSFSRRSACRRHQRTHT GEKPYKCPECGKSFSRSDH LTTHQRTHTGEKPYKCPEC GKSFSQSSSLVRHQRTHTG KKTS | 718 | 914 |
| eZFP_28 | CCGAT CCATA CTGCG GAA (SEQ ID NO: 1055) | F1: QSSNLVR (SEQ ID NO: 882) F2: RSDDLVR (SEQ ID NO: 883) F3: THLDLIR (SEQ ID NO: 884) F4: TSGNLTE (SEQ ID NO: 885) F5: RRSACRR (SEQ ID NO: 886) F6: RNDTLTE (SEQ ID NO: 887) | LEPGEKPYACPECGKSFSQS SNLVRHQRTHTGEKPYKCP ECGKSFSRSDDLVRHQRTH TGEKPYKCPECGKSFSTHL DLIRHQRTHTGEKPYACPE CGKSFSTSGNLTEHQRTHT GEKPYKCPECGKSFSRRSA CRRHQRTHTGEKPYKCPEC GKSFSRNDTLTEHQRTHTG KKTS | 719 | 915 |

TABLE E5 eZFP-KRAB fusion proteins

| SEQ ID NOS | Sequence | Description |
|---|---|---|
| 916 | ATGGCACCGAAGAAAAAACGCAAAGTTGGTCGAGTACCCGCTGCTATG GCAGAGCGGCCATTTCAGTGTCGAATTTGCATGCGAAATTTCTCTAGCG AAGCGGATCGAAGTAGACATATCCGGACCCATACGGGTGAGAAACCGT TCGCGTGTGATATATGCGGTCGCAAATTCGCAGACCGCTCCAACCTGAC AAGGCACACAAAAATTCATACTGGAAGCCAGAAACCGTTTCAGTGCCG GATTTGTATGCGCAATTTCTCTCAATCCTCCGATCTCTCCCGCCACATCA GGACTCATACCGGGGAGAAACCCTTTGCTTGTGACATTTGTGGCAGAAA GTTTGCCTATCACTGGTACCTTAAGAAGCACACCAAGATCCATACTGGC TCTCAAAAGCCTTTCCAATGCCGAATATGTATGCGAAACTTTTCTAGGT CTGACTCCCTCTGTACATATCCGCACTCACACGGGTGAAAAACCATT TGCCTGTGACATATGTGGCAGAAATTTGCTCAAAATGCGAACCGAAA AACGCATACGAAAATCCATTTGCGACAAAAAGATGCAGCTCGGGGCTC CGGACCGAAAAAAGAGAAAGGTAAACGGCGGGGAGGATCACGGA CCCTGGTTACATTTAAGGACGTTTTTGTAGACTTCACGAGGGAGGAATG GAAGCTGTTGGACACCGCCCAGCAAATCGTGTATCGAAATGTAATGTTG GAAAATTATAAAAATCTGGTTTCCCTCGGCTACCAATTGACAAAACCAG ACGTCATCCTCAGACTGGAAAAAGGGGAAGAACCTTGGCTTGTCTGA | 3xFLAG-SV40 NLS--ZFP-SV40-NLS-KRAB (DNA Sequence) |

TABLE E5-continued eZFP-KRAB fusion proteins

| SEQ ID NOS | Sequence | Description |
|---|---|---|
| 917 | ATGGCACCGAAGAAAAAACGCAAAGTTGGTCGAGTACCCGCGGCAATG<br>GCAGAACGCCCGTTTCAGTGTAGAATCTGCATGCGCAATTTCTCCAGAA<br>GTGACGTACTCAGCACGCATATCAGAACACATACTGGTGAAAAACCGTT<br>TGCTTGTGATATCTGTGGTAAGAAATTCGCGGATAACTCCTCAAGGACG<br>CGGCATACGAAGATCCACACTGGTTCTCAAAAGCCGTTCCAGTGCCGGA<br>TATGCATGCGGAACTTTAGTCGGCATATACGCTTCGACTTCATATTAG<br>GACTCACACCGGCGAAAAGCCGTTCGCCTGTGACATTTGCGGGAGAAA<br>ATTCGCTGACTCTAGTCACCGCACGAGGCACACTAAAATACATACTGGT<br>TCACAAAAACCATTCCAGTGCCGAATTTGCATGCGAAATTTTTCCCGAA<br>GTGACCATCTCTCACAGCACATCCGCACCCATACAGGGGAGAAGCCCTT<br>CGCTTGTGATATATGCGGACGCAAGTTCGCGGACAGCTCACACCGGACC<br>CGCCATACAAAGATCCACTTGAGACAGAAAGATGCAGCGCGGGGCTCC<br>GGACCGAAAAAAAGAGAAAGGTAAACGGCGGGGGAGGATCACGGAC<br>CCTGGTTACATTTAAGGACGTTTTTGTAGACTTCACGAGGGAGGAATGG<br>AAGCTGTTGGACACCGCCCAGCAAATCGTGTATCGAAATGTAATGTTGG<br>AAAATTATAAAAATCTGGTTTCCCTCGGCTACCAATTGACAAAACCAGA<br>CGTCATCCTCAGACTGGAAAAAGGGGAAGAACCTTGGCTTGTCTGA | 3xFLAG-SV40<br>NLS--ZFP-<br>SV40-NLS-<br>KRAB (DNA<br>Sequence) |
| 918 | ATGGCACCGAAGAAAAAACGCAAAGTTGGTCGAGTACCCGCCGCAATG<br>GCCGAAAGACCATTTCAGTGCAGGATATGTATGCGCAACTTCTCTCGCA<br>GTGACCACCTGAGTCAACATATCAGGACACACACGGGTGAAAAGCCTT<br>TGCATGCGATATTTGTGGTCGAAAATTTGCTCAGTCTGCGGACCGAAC<br>CAAGCACACTAAAATTCATACCGGCTCACAGAAACCGTTTCAATGCCGC<br>ATCTGTATGAGGAATTTCTCTAGATCAGACCACTTGTCCCAACACATCC<br>GGACTCATACTGGAGAAAAGCCGTTTGCATGTGACATTTGTGGCAGGAA<br>GTTTGCTAGAAGGTCTGACCTTAAAAGGCACACAAAAATTCATACGGGT<br>TCCCAGAAACCATTTCAGTGCCGGATATGCATGCGGAACTTTTCACGAA<br>GCGACCACCTCTCCCGACATATTCGAACGCACACTGGTGAGAAGCCGTT<br>TGCTTGCGACATTTGCGGACGCAAGTTCGCTCAGAGCTCCGACTTGAGG<br>AGGCATACCAAGATTCATCTCCGGCAGAAAGATGCCGCGCGGGGCTCC<br>GGACCGAAAAAAAGAGAAAGGTAAACGGCGGGGGAGGATCACGGAC<br>CCTGGTTACATTTAAGGACGTTTTTGTAGACTTCACGAGGGAGGAATGG<br>AAGCTGTTGGACACCGCCCAGCAAATCGTGTATCGAAATGTAATGTTGG<br>AAAATTATAAAAATCTGGTTTCCCTCGGCTACCAATTGACAAAACCAGA<br>CGTCATCCTCAGACTGGAAAAAGGGGAAGAACCTTGGCTTGTCTGA | 3xFLAG-SV40<br>NLS--ZFP-<br>SV40-NLS-<br>KRAB (DNA<br>Sequence) |
| 919 | ATGGCACCGAAGAAAAAACGCAAAGTTGGTCGAGTACCCGCCGCGATG<br>GCTGAGAGACCATTTCAGTGTCGAATCTGCATGAGAAATTTTTCAAGGA<br>GTGACAATCTGTCTGAGCACATACGAACACATACTGGGGAAAAACCCTT<br>TGCATGTGACATTTGTGGAAGAAAGTTTGCTACCAGCTCAAATCGCAAA<br>ACACATACAAAGATACATACCGGCTCCCAAAAGCCATTCCAGTGCCGC<br>ATCTGCATGAGGAACTTTTCCGATCGCTCACATCTTACCCGCCACATAA<br>GAACTCACACAGGCGAAAAGCCCTTTGCCTGCGATATATGCGGACGGA<br>AGTTCGCCCGCTCCGACGCTTTGACCCAGCATACCAAAATCCATACTGG<br>GTCTCAAAAGCCATTTCAGTGCCGAATCTGTATGAGGAATTTCTCCGAC<br>AGGTCAGCATTGGCACGGCATATCCGCACCCATACCGGTGAGAAGCCTT<br>TGCTTGCGATATCTGTGGACGAAAATTTGCCCGGAGGTTCACTCTCTCC<br>AAACACACAAAGATACATCTGCGCCAAAAGGATGCAGCCCGGGGCTCC<br>GGACCGAAAAAAAGAGAAAGGTAAACGGCGGGGGAGGATCACGGAC<br>CCTGGTTACATTTAAGGACGTTTTTGTAGACTTCACGAGGGAGGAATGG<br>AAGCTGTTGGACACCGCCCAGCAAATCGTGTATCGAAATGTAATGTTGG<br>AAAATTATAAAAATCTGGTTTCCCTCGGCTACCAATTGACAAAACCAGA<br>CGTCATCCTCAGACTGGAAAAAGGGGAAGAACCTTGGCTTGTCTGA | 3xFLAG-SV40<br>NLS--ZFP-<br>SV40-NLS-<br>KRAB (DNA<br>Sequence) |
| 920 | ATGGCACCGAAGAAAAAACGCAAAGTTGGTCGAGTACCCGCCGCAATG<br>GCTGAGCGCCCGTTCCAGTGCAGAATATGCATGCGGAATTTTTCTAGGT<br>CAGATCATTTGTCTGAGCATATTCGCACACACACGGGAGAGAAGCCCTT<br>TGCTTGCGATATATGTGGAAGGAAATTCGCGCAATACAGTGGGCGCTAC<br>TACCATACAAAGATCCATACGGGCTCCCAGAAGCCCTTCCAATGTCGAA<br>TATGTATGAGGAATTTTAGTCACGGACAAACATTGAATGAACATATACG<br>CACTCACACTGGTGAAAAACCATTTGCGTGCGATATTTGCGGAAGGAAG<br>TTTGCTCAGTCTGGGAATTTGGCGCGACACACCAAGATCCACACAGGAT<br>CCCAGAAACCATTTCAGTGCAGAATTTGTATGAGAAACTTTAGCCGCAG<br>TGACAGTCTCTTGAGGCACATACGGACTCATACTGGGGAGAAACCATTC<br>GCCTGCGATATTTGTGGACAGAAAGTTCGCCTGTCGCGAGTACAGAGGCA<br>AGCACACTAAGATACATCTTAGGCAAAAGGACGCTGCACGGGGCTCCG<br>GACCGAAAAAAGAGAAAGGTAAACGGCGGGGGAGGATCACGGACC<br>CTGGTTACATTTAAGGACGTTTTTGTAGACTTCACGAGGGAGGAATGGA<br>AGCTGTTGGACACCGCCCAGCAAATCGTGTATCGAAATGTAATGTTGGA<br>AAATTATAAAAATCTGGTTTCCCTCGGCTACCAATTGACAAAACCAGAC<br>GTCATCCTCAGACTGGAAAAAGGGGAAGAACCTTGGCTTGTCTGA | 3xFLAG-SV40<br>NLS--ZFP-<br>SV40-NLS-<br>KRAB (DNA<br>Sequence) |

TABLE E5-continued eZFP-KRAB fusion proteins

| SEQ ID NOS | Sequence | Description |
|---|---|---|
| 921 | ATGGCACCGAAGAAAAAACGCAAAGTTGGTCGAGTACCCGCCGCGATG<br>GCTGAGAGGCCTTTTCAATGTCGAATCTGTATGAGGAACTTCTCTCAAT<br>CTGCTAATCGCACGACGCACATTCGAACGCATACCGGTGAGAAGCCATT<br>CGCGTGCGATATCTGCGGACGGAAATTCGCGAGGTCAGCTAATCTTACA<br>CGGCACACGAAGATCCACACAGGGTCACAGAAACCTTTTCAGTGTCGC<br>ATTTGCATGAGGAATTTCTCCCGATCTGACGTCCTTAGCGAACATATAC<br>GAACTCACACGGGCGAGAAGCCATTTGCGTGCGATATATGCGGGAGGA<br>AGTTTGCCACCTCTGGACATCTGAGTCGACATACCAAAATTCATACCGG<br>TAGTCAGAAGCCGTTCCAATGCAGAATATGTATGCGAAATTTCTCTCAA<br>AGCTCAGACTTGTCTAGGCACATAAGAACGCACACGGGTGAAAAACCT<br>TTCGCGTGTGATATCTGCGGCAGAAAGTTCGCACAATGGTCCACCCGAA<br>AGCGGCATACGAAGATTCACCTCAGACAGAAAGACGCTGCCCGGGGCT<br>CCGGACCGAAAAAAAGAGAAAGGTAAACGGCGGGGGAGGATCACGG<br>ACCCTGGTTACATTTAAGGACGTTTTTGTAGACTTCACGAGGGAGGAAT<br>GGAAGCTGTTGGACACCGCCCAGCAAATCGTGTATCGAAATGTAATGTT<br>GGAAAATTATAAAAATCTGGTTTCCCTCGGCTACCAATTGACAAAACCA<br>GACGTCATCCTCAGACTGGAAAAAGGGGAAGAACCTTGGCTTGTCTGA | 3xFLAG-SV40<br>NLS--ZFP-<br>SV40-NLS-<br>KRAB (DNA<br>Sequence) |
| 922 | ATGGCACCGAAGAAAAAACGCAAAGTTGGTCGAGTACCCGCGGCGATG<br>GCAGAACGCCCGTTCCAATGCAGAATATGTATGAGAAACTTCTCCCAGA<br>GCGGAAATCTGGCACGCCACATCCGGACACACACGGGAGAGAAGCCAT<br>TTGCTTGTGACATTTGTGGTCGCAAATTTGCCGCCACCTGTTGTCTGGCA<br>CATCATACTAAGATACATACGGGGTCACAGAAACCATTCCAATGTAGG<br>ATCTGCATGCGGAATTTTTCTCGGTGGCAGTATTTGCCTACGCATATTAG<br>AACCCACGCCGGTGAGAAACCGTTTGCATGTGACATCTGCGGACGAAA<br>GTTTGCCGATAGATCTGCGCTTGCTAGGCATACTAAAATCCACACGGGG<br>TCCCAAGAGCCTTTTCAGTGTCGGATATGTATGAGGAACTTCAGTCGAT<br>CAGACAACCTTAGCGAGCATATTCGGACGCATACTGGAGAAAACCTTT<br>TGCTTGTGATATATGCGGTAGGAAGTTCGCCAAACGGTGTAACCTTCGC<br>TGTCACACCAAAATACATCTTCGCCAGAAAGATGCGGCCCGGGGCTCCG<br>GACCGAAAAAAAAGAGAAAGGTAAACGGCGGGGGAGGATCACGGACC<br>CTGGTTACATTTAAGGACGTTTTTGTAGACTTCACGAGGGAGGAATGGA<br>AGCTGTTGGACACCGCCCAGCAAATCGTGTATCGAAATGTAATGTTGGA<br>AAATTATAAAAATCTGGTTTCCCTCGGCTACCAATTGACAAAACCAGAC<br>GTCATCCTCAGACTGGAAAAAGGGGAAGAACCTTGGCTTGTCTGA | 3xFLAG-SV40<br>NLS--ZFP-<br>SV40-NLS-<br>KRAB (DNA<br>Sequence) |
| 923 | ATGGCACCGAAGAAAAAACGCAAAGTTGGTCGAGTACCCGCCGCTATG<br>GCTGAAAGACCATTCCAGTGCAGAATATGTATGAGGAATTTTTCTAATC<br>CCGCGAACCTTACGCGCCATATCAGGACGCACACGGGCGAAAAGCCCT<br>TCGCCTGCGACATTTGTGGGAGAAAGTTTGCTCAAAACGCGACCAGGAC<br>AAAGCACACGAAAATTCACACTGGTAGCCAGAAGCCGTTCCAGTGTAG<br>GATCTGTATGCGCAATTTCTCTCAGTCCGGGCACCTCGCGCGACACATA<br>AGAACTCATACGGGGGAGAAGCCGTTTGCATGTGACATCTGCGGCCGC<br>AAGTTTGCGAATAGGCATGACAGGGCAAAACATACGAAGATCCATACA<br>GGTTCTCAAAAACCTTTCCAATGTCGAATATGCATGCGAACTTTAGTC<br>GGTCAGACCACCTTTCTGAACACATCAGGACACACACTGGCGAAAAGC<br>CGTTCGCATGTGACATTTGCGGCAGAAAGTTCGCACAAAGACGGTCCCG<br>CTATAAGCACACCAAAATTCACCTTAGGCAAAAGGATGCAGCTCGGGG<br>CTCCGGACCGAAAAAAAAGAGAAAGGTAAACGGCGGGGGAGGATCAC<br>GGACCCTGGTTACATTTAAGGACGTTTTTGTAGACTTCACGAGGGAGGA<br>ATGGAAGCTGTTGGACACCGCCCAGCAAATCGTGTATCGAAATGTAATG<br>TTGGAAAATTATAAAAATCTGGTTTCCCTCGGCTACCAATTGACAAAAC<br>CAGACGTCATCCTCAGACTGGAAAAAGGGGAAGAACCTTGGCTTGTCT<br>GA | 3xFLAG-SV40<br>NLS--ZFP-<br>SV40-NLS-<br>KRAB (DNA<br>Sequence) |
| 924 | ATGGCACCGAAGAAAAAACGCAAAGTTGGTCGAGTACCCGCGGCAATG<br>GCAGAACGACCCTTCCAATGCCGCATATGTATGCGAAACTTCAGCCAGA<br>GCTCAGATCTTTCCAGACACATCAGGACTCACACTGGCGAAAAACCATT<br>TGCATGCGATATATGCGGGAGAAAATTCGCGCACCGCAGTACGCGAAA<br>CAGGCATACAAAGATACATACTGGCAGTCAAAAGCCATTTCAATGTCG<br>AATATGCATGAGGAACTTTAGTCGATCTGACGTGCTGAGCGCTCACATA<br>CGGACCCATACCGAGAGAAACCATTCGCTTGTGACATCTGTGGTAGGA<br>AGTTCGCGGATTCCCGGACCCGCAAAAATCATACTAAAATTCACACTGG<br>GTCTCAGAAGCCCTTTCAGTGTAGGATATGTATGCGCAATTTTAGCCAG<br>AGTGGTTCATTGACTCGGCATATCAGAACACATACTGGAGAGAAACCTT<br>TCGCGTGTGATATTTGCGGTCGAAAGTTCGCAGATCAGAGTGGACTTGC<br>GCACCATACTAAGATCCACCTGAGACAGAAGGACGCTGCGCGGGCTC<br>CGGACCGAAAAAAAGAGAAAGGTAAACGGCGGGGGAGGATCACGGA<br>CCCTGGTTACATTTAAGGACGTTTTTGTAGACTTCACGAGGGAGGAATG<br>GAAGCTGTTGGACACCGCCCAGCAAATCGTGTATCGAAATGTAATGTTG<br>GAAAATTATAAAAATCTGGTTTCCCTCGGCTACCAATTGACAAAACCAG<br>ACGTCATCCTCAGACTGGAAAAAGGGGAAGAACCTTGGCTTGTCTGA | 3xFLAG-SV40<br>NLS--ZFP-<br>SV40-NLS-<br>KRAB (DNA<br>Sequence) |

TABLE E5-continued eZFP-KRAB fusion proteins

| SEQ ID NOS | Sequence | Description |
|---|---|---|
| 925 | ATGGCACCGAAGAAAAAACGCAAAGTTGGTCGAGTACCCGCTGCCATG<br>GCGGAGCGCCCTTTCCAGTGTAGGATATGTATGCGCAACTTCAGTCAGA<br>ACCCAGCCCAGTGGCGGCACATACGGACGCATACTGGAGAAAAGCCAT<br>TTGCATGTGATATCTGCGGGCGAAAATTCGCGCGGTCAGCAGATTTGAG<br>CCGGCATACGAAGATCCATACAGGTTCACAAAAGCCATTTCAATGTCGG<br>ATATGTATGCGGAACTTCAGCACGTCCGGCTCATTGTCAAGACATATAC<br>GAACTCATACCGGAGAGAAACCTTCGCGTGCGACATTTGCGGTCGGA<br>AGTTCGCGCGATCCGACCATCTGTCACGACATACGAAAATACACACTGG<br>CTCTCAAAAGCCGTTTCAGTGCAGAATTTGCATGAGAAATTTTAGCAGG<br>AGCGACTCACTCCTTCGGCATATACGAACACACACTGGTGAGAAGCCAT<br>TTGCCTGTGATATTTGTGGACGAAAGTTTGCGCAATCTTACGATAGGTTT<br>CAGCATACAAAAATCCACCTTCGGCAAAAGGACGCGGCACGGGGCTCC<br>GGACCGAAAAAAAAGAGAAAGGTAAACGGCGGGGGAGGATCACGGAC<br>CCTGGTTACATTTAAGGACGTTTTTGTAGACTTCACGAGGGAGGAATGG<br>AAGCTGTTGGACACCGCCCAGCAAATCGTGTATCGAAATGTAATGTTGG<br>AAAATTATAAAAATCTGGTTTCCCTCGGCTACCAATTGACAAAACCAGA<br>CGTCATCCTCAGACTGGAAAAAGGGGAAGAACCTTGGCTTGTCTGA | 3xFLAG-SV40<br>NLS--ZFP-<br>SV40-NLS-<br>KRAB (DNA<br>Sequence) |
| 926 | ATGGCACCGAAGAAAAAACGCAAAGTTGGTCGAGTACCCGCTGCCATG<br>GCTGAACGACCGTTTCAATGTCGAATTTGCATGCGCAACTTCTCCACGT<br>CCGGGTCTCTCAGTAGACACATCAGAACGCATACTGGTGAAAAACCATT<br>CGCTTGTGACATATGCGGCCGAAAATTCGCGCGGAGCGACCACCTGTCA<br>CGGCATACCAAAATTCACACCGGGAGTCAAAAACCGTTCCAGTGTAGG<br>ATATGTATGCGCAACTTCAGCCGGTCTGACAGTCTGCTTCGACATATTC<br>GGACGCACACTGGTGAAAAGCCGTTTGCGTGCGACATTTGTGGTCGAAA<br>GTTCGCTCAATCTTATGATAGGTTTCAACACACCAAAATACATACGGGC<br>TCCCAGAAGCCGTTCCAGTGCAGAATATGCATGAGAAATTTCTCTCGCA<br>GTGACAATTTGTCCACCCATATTCGAACGCACACCGGCGAGAAACCCTT<br>CGCCTGCGATATTTGCGGTCGCAAGTTCGCAGACAACAGGGATAGGAT<br>AAAACATACGAAGATCCATCTGAGGCAAAAAGACGCCGCCCGGGGCTC<br>CGGACCGAAAAAAAGAGAAAGGTAAACGGCGGGGGAGGATCACGGA<br>CCCTGGTTACATTTAAGGACGTTTTTGTAGACTTCACGAGGGAGGAATG<br>GAAGCTGTTGGACACCGCCCAGCAAATCGTGTATCGAAATGTAATGTTG<br>GAAAATTATAAAAATCTGGTTTCCCTCGGCTACCAATTGACAAAACCAG<br>ACGTCATCCTCAGACTGGAAAAAGGGGAAGAACCTTGGCTTGTCTGA | 3xFLAG-SV40<br>NLS--ZFP-<br>SV40-NLS-<br>KRAB (DNA<br>Sequence) |
| 927 | ATGGCACCGAAGAAAAAACGCAAAGTTGGTCGAGTACCCGCAGCCATG<br>GCAGAGCGGCCATTCCAGTGCAGAATCTGCATGCGGAACTTTTCCGATA<br>GGTCCAATCTGTCACGACCATATTAGGACACACACGGGTGAAAAACCGTT<br>CGCGTGTGACATATGCGGTCGCAAATTCGCCCTGAGACAGAACCTGATT<br>ATGCACACAAAATACATACGGGAAGCCAGAAACCGTTCCAGTGTCGG<br>ATATGCATGAGGAACTTCAGTGAGAGGGGACTTTGGCGAGGCACATC<br>AGGACTCACACTGGGGAGAAGCCCTTTGCATGTGATATCTGTGGCCGAA<br>AATTTGCTCGATCAGATGCTCTCACCCAACATACAAAGATCCATACTGG<br>CTCTCAAAAACCGTTTCAATGTAGAATTTGTATGCGCAACTTCTCTCGGT<br>CAGATAGCCTGTCCCAGCATATCCGAACTCATACAGGTGAGAAACCCTT<br>CGCATGCGACATCTGTGGGCGAAAATTTGCTAGAAAAGCAGACCGGAC<br>CCGACACACAAAGATTCATCTGCGACAAAAAGACGCCGCCCGGGGCTC<br>CGGACCGAAAAAAAGAGAAAGGTAAACGGCGGGGGAGGATCACGGA<br>CCCTGGTTACATTTAAGGACGTTTTTGTAGACTTCACGAGGGAGGAATG<br>GAAGCTGTTGGACACCGCCCAGCAAATCGTGTATCGAAATGTAATGTTG<br>GAAAATTATAAAAATCTGGTTTCCCTCGGCTACCAATTGACAAAACCAG<br>ACGTCATCCTCAGACTGGAAAAAGGGGAAGAACCTTGGCTTGTCTGA | 3xFLAG-SV40<br>NLS--ZFP-<br>SV40-NLS-<br>KRAB (DNA<br>Sequence) |
| 928 | ATGGCACCGAAGAAAAAACGCAAAGTTGGTCGAGTACCCGCGGCCATG<br>GCTGAGAGGCCTTTTCAATGTAGAATATGTATGCGAAATTTTTCACAGT<br>ACTGTTGTCTCACGAACCACATAAGGACTCATACAGGGGAGAAACCATT<br>TGCCTGTGACATTTGCGGTCGCAAATTTGCTACTTCTGGAAACCTGACTC<br>GGCACACTAAGATTCACACAGGGTCCCAGAAGCCCTTCCAGTGTCGCAT<br>TTGCATGAGGAATTTAGTCAAAGCTCTGACTTGTCAAGGCATATTCGC<br>ACGCACACGGGCGAAAAGCCGTTCGCTTGCGACATATGCGGGCGGAAA<br>TTTGCCTTCCGCTATTATTTGAAGAGACACACCAAGATACATACGGGCT<br>CTCAGAAGCCCTTTCAGTGTAGGATTTGCATGCGCAATTTTTCACAATCT<br>GGTGATCTCACGCGACACATCCGGACTCACACAGGTGAAAAGCCTTTCG<br>CGTGCGACATTTGCGGCCGGAAGTTTGCTGACAAGGGCAACCTCACAA<br>AGCATACGAAGATTCACTTGAGGCAGAAAGATGCTGCTCGGGGCTCCG<br>GACCGAAAAAAGAGAAAGGTAAACGGCGGGGGAGGATCACGGACC<br>CTGGTTACATTTAAGGACGTTTTTGTAGACTTCACGAGGGAGGAATGGA<br>AGCTGTTGGACACCGCCCAGCAAATCGTGTATCGAAATGTAATGTTGGA<br>AAATTATAAAAATCTGGTTTCCCTCGGCTACCAATTGACAAAACCAGAC<br>GTCATCCTCAGACTGGAAAAAGGGGAAGAACCTTGGCTTGTCTGA | 3xFLAG-SV40<br>NLS--ZFP-<br>SV40-NLS-<br>KRAB (DNA<br>Sequence) |

TABLE E5-continued eZFP-KRAB fusion proteins

| SEQ ID NOS | Sequence | Description |
|---|---|---|
| 929 | ATGGCACCGAAGAAAAAACGCAAAGTTGGTCGAGTACCCGCCGCCATG GCCGAACGACCATTCCAGTCAGGATATGTATGCGCAATTTTTCAACCA GTGGTTCATTGTCACGACATATTAGAACACACACCGGTGAGAAACCCTT TGCGTGTGACATCTGTGGGAGGAAATTCGCAAGATCTGACAACCTTACG ACACATACAAAGATTCACACAGGCTCTCAAAAGCCCTTCCAGTGCCGAA TTTGCATGCGAAACTTTTCCCAGTCTGGTAATCTCGCTCGACATATCAGA ACCCACACGGGGAAAAACCATTCGCTTGTGATATTTGCGGACGAAAG TTCGCCGACAGAACCACACTCATGAGACACACTAAAATCCATACTGGTA GTCAGAAGCCGTTTCAGTGTAGAATCTGCATGAGGAACTTTTCCCAGTC AGGCCACCTTGCAAGACATATACGAACTCACACTGGAGAAAAGCCGTT CGCCTGTGACATTTGTGGGCGCAAGTTCGCGCAACTCACCCATCTGAAT AGCCATACGAAGATTCACTTGAGACAGAAAGATGCGGCTCGGGGCTCC GGACCGAAAAAAAGAGAAAGGTAAACGGCGGGGGAGGATCACGGAC CCTGGTTACATTTAAGGACGTTTTTGTAGACTTCACGAGGGAGGAATGG AAGCTGTTGGACACCGCCCAGCAAATCGTGTATCGAAATGTAATGTTGG AAAATTATAAAAATCTGGTTTCCCTCGGCTACCAATTGACAAAACCAGA CGTCATCCTCAGACTGGAAAAAGGGGAAGAACCTTGGCTTGTCTGA | 3xFLAG-SV40 NLS--ZFP-SV40-NLS-KRAB (DNA Sequence) |
| 930 | ATGGCACCGAAGAAAAAACGCAAAGTTGGTCGAGTACCCGCAGCTATG GCTGAACGCCCATTCCAGTGTCGGATCTGCATGCGCAACTTTTCTATAA AACACGATCTTCACCGACACATTCGGACACATACTGGGGAGAAGCCCTT TGCGTGTGACATCTGTGGCCGAAAGTTCGCTAGATCCGCAAACTTGACT CGGCATACGAAAATTCACACTGGAAGCCAGAAACCTTTCCAATGTCGA ATCTGTATGAGGAACTTTAGCAGAAGTGATAATCTCGCAGGCATATCC GAACGCACACAGGCGAGAAGCCATTCGCATGTGATATTTGTGGTAGAA AGTTCGCCCAAAATGTCTCTCGCCCACGCCATACTAAGATCCACACGGG CTCCCAGAAGCCGTTCCAATGCCGCATTTGCATGCGAAACTTTTCCAGA TCAGACGATCTGAGCAAGCATATTAGGACGCATACAGGGGAGAAGCCT TTTGCTTGCGACATTTGCGGCCGGAAATTTGCTGACTCAAGTCACAGAA CACGGCATACCAAGATACACCTTCGACAAAAAGATGCCGCACGGGGCT CCGGACCGAAAAAAAAGAGAAAGGTAAACGGCGGGGGAGGATCACGG ACCCTGGTTACATTTAAGGACGTTTTTGTAGACTTCACGAGGGAGGAAT GGAAGCTGTTGGACACCGCCCAGCAAATCGTGTATCGAAATGTAATGTT GGAAAATTATAAAAATCTGGTTTCCCTCGGCTACCAATTGACAAAACCA GACGTCATCCTCAGACTGGAAAAAGGGGAAGAACCTTGGCTTGTCTGA | 3xFLAG-SV40 NLS--ZFP-SV40-NLS-KRAB (DNA Sequence) |
| 931 | ATGGCACCGAAGAAAAAACGCAAAGTTGGTCGAGTACCCGCGGCCATG GCGGAACGACCCTTTCAGTGCCGAATTTGCATGAGGAACTTTTCACGAT CTGATAACCTGGCGAGGCACATCCGAACACATACGGGCGAGAAGCCAT TCGCATGTGATATCTGCGGGCGAAAGTTCGCCCAAAATGTCAGTAGACC GCGACATACTAAAATACACACTGGCTCACAGAAGCCGTTCCAATGCCGC ATCTGTATGCGCAATTTTTCCCGAAGCGACGATCTGTCTAAACATATTC GGACGCACACTGGGGAAAAGCCTTTCGCTTGTGACATCTGTGGGAGGA AGTTCGCTGACAGCTCTCATAGGACACGCCATACTAAGATTCATACCGG AAGCCAGAAGCCTTTCCAGTGTCGGATTTGCATGAGAAACTTTAGCACT TCTAGCAACAGAAAGACACATATACGAACCCATACGGGTGAGAAACCG TTCGCATGCGATATCTGTGGGCGAAAATTTGCAGCCCAATGGACCAGAG CTTGCCATACCAAGATACACCTTCGGCAGAAGGACGCTGCACGGGCTC CGGACCGAAAAAAAGAGAAAGGTAAACGGCGGGGGAGGATCACGGA CCCTGGTTACATTTAAGGACGTTTTTGTAGACTTCACGAGGGAGGAATG GAAGCTGTTGGACACCGCCCAGCAAATCGTGTATCGAAATGTAATGTTG GAAAATTATAAAAATCTGGTTTCCCTCGGCTACCAATTGACAAAACCAG ACGTCATCCTCAGACTGGAAAAAGGGGAAGAACCTTGGCTTGTCTGA | 3xFLAG-SV40 NLS--ZFP-SV40-NLS-KRAB (DNA Sequence) |
| 932 | ATGGCACCGAAGAAAAAACGCAAAGTTGGTCGAGTACCCGCTGCGATG GCAGAACGACCTTTTCAATGCCGAATTTGTATGAGGAACTTTTCCCGGT CAGACGACCTTTCCAAGCACATCAGAACTCATACCGGAGAAAAACCGT TCGCCTGTGACATTTGTGGACGGAAGTTTGCTGACTCCTCTCACAGGAC TCGCCACACTAAGATACACACCGGAAGTCAGAAGCCCTTCCAATGTAG GATATGCATGAGAAACTTCAGTACGTCATCAAACCGAAAAACGCATAT CAGGACACATACCGGCGAAAAGCCGTTTGCATGTGATATCTGCGGCAG GAAATTTGCAGCTCAGTGGACACGGGCATGTCACACAAAAATCCATAC CGGTAGTCAAAAACCGTTTCAGTGTCGAATCTGCATGAGGAACTTTAGC CGGAAGCAGACGAGAACCACGCATATAAGAACTCACACAGGTGAGAAA CCCTTTGCGTGCGATATCTGCGGTCGCAAATTTGCTCACCGATCCTCCCT GAGGCGACATACTAAAATACATCTGCGCACAGAAAGACGCGGCTCGGGG CTCCGGACCGAAAAAAAGAGAAAGGTAAACGGCGGGGGAGGATCAC GGACCCTGGTTACATTTAAGGACGTTTTTGTAGACTTCACGAGGGAGGA ATGGAAGCTGTTGGACACCGCCCAGCAAATCGTGTATCGAAATGTAATG TTGGAAAATTATAAAAATCTGGTTTCCCTCGGCTACCAATTGACAAAAC CAGACGTCATCCTCAGACTGGAAAAAGGGGAAGAACCTTGGCTTGTCT GA | 3xFLAG-SV40 NLS--ZFP-SV40-NLS-KRAB (DNA Sequence) |

TABLE E5-continued eZFP-KRAB fusion proteins

| SEQ ID NOS | Sequence | Description |
|---|---|---|
| 933 | ATGGCACCGAAGAAAAAACGCAAAGTTGGTCGAGTACCCGCCGCCATG GCAGAACGGCCTTTTCAGTGTCGGATCTGCATGAGAAACTTTAGTCAGA GTGCCCATCGCAAGAATCATATTCGAACTCATACCGGTGAAAAACCGTT CGCGTGCGACATCTGTGGTCGAAAGTTTGCCACATCATCCAATAGAAAA ACGCATACTAAGATTCATACCGGTAGCCAGAAACCATTCCAATGTAGAA TCTGCATGCGAAATTTCAGCAGGAGTGACAATTTGTCCGCACATATACG GACACACACGGGCGAAAAACCCTTTGCTTGCGATATATGCGGTAGAAA GTTCGCTAGGAACAACGACCGAAAAACACACACGAAGATTCATACAGG TAGTCAGAAGCCATTTCAATGTCGGATCTGTATGCGAAATTTCTCTACTT CTGGCAGCCTGTCCCGGCACATCAGAACACATACCGGTGAGAAGCCATT TGCATGTGACATATGTGGGAGAAATTTGCCCAGGCGGGTCACCTTGCG AAGCATACAAAGATCCACCTCCGCCAGAAGGACGCCGCACGGGGCTCC GGACCGAAAAAAAAGAGAAAGGTAAACGGCGGGGGAGGATCACGGAC CCTGGTTACATTTAAGGACGTTTTTGTAGACTTCACGAGGGAGGAATGG AAGCTGTTGGACACCGCCCAGCAAATCGTGTATCGAAATGTAATGTTGG AAAATTATAAAAATCTGGTTTCCCTCGGCTACCAATTGACAAAACCAGA CGTCATCCTCAGACTGGAAAAAGGGGAAGAACCTTGGCTTGTCTGA | 3xFLAG-SV40 NLS--ZFP-SV40-NLS-KRAB (DNA Sequence) |
| 934 | ATGGCACCGAAGAAAAAACGCAAAGTTGGTCGAGTACCCGCGGCTATG GCAGAGCGGCCATTCCAATGTAGGATATGTATGAGGAACTTCTCCCGGA GCGATCACCTGTCCCAACACATCCGCACGCATACGGGTGAGAAGCCGTT TGCTTGTGATATCTGCGGAAGAAAATTTGCAGCATCCAGTACACGCACA AAGCATACGAAGATTCATACGGGATCCCAAAAGCCCTTTCAATGCAGG ATTTGTATGAGGAACTTCAGTCGGTCCGACGATCTGACACGACATATTA GAACTCATACTGGAGAGAAGCCATTCGCATGTGACATCTGCGGTAGGA AGTTCGCGCAGAAATCTAACCTGTCATCTCACACCAAGATACATACAGG CTCACAGAAGCCGTTTCAATGCCGCATCTGCATGAGGAATTTCAGCCAG TCCGCAAACAGAACTACGCATATTCGGACGCATACCGGCGAGAAGCCG TTTGCCTGCGACATTTGCGGGAGGAAATTCGCACAGAACGCGACCAGA ACCAAACACACCAAAATCCATCTTAGGCAAAAGGATGCGGCCCGGGGC TCCGGACCGAAAAAAAAGAGAAAGGTAAACGGCGGGGGAGGATCACG GACCCTGGTTACATTTAAGGACGTTTTTGTAGACTTCACGAGGGAGGAA TGGAAGCTGTTGGACACCGCCCAGCAAATCGTGTATCGAAATGTAATGT TGGAAAATTATAAAAATCTGGTTTCCCTCGGCTACCAATTGACAAAACC AGACGTCATCCTCAGACTGGAAAAAGGGGAAGAACCTTGGCTTGTCTG A | 3xFLAG-SV40 NLS--ZFP-SV40-NLS-KRAB (DNA Sequence) |
| 935 | ATGGCACCGAAGAAAAAACGCAAAGTTGGTCGAGTACCCGCGGCCATG GCAGAACGACCCTTTCAGTGCCGAATTTGCATGCGGAACTTTAGTCGCA GTGCACACCCTGAGCGAGCATATTCGCACGCATAGGGAGAAGCCAT TTGCATGCGACATCTGCGGTAGAAAGTTTGCGAGGCGCTGGACGTTGGT AGGCCACACGAAAATCCATACAGGCTCCCAGAAACCCTTCCAGTGCAG AATTTGTATGCGCAATTTTAGTGACAGAAGTAACTTGTCCCGACATATA AGGACGCACACCGGCGAAAAACCGTTTGCCTGTGATATCTGTGGTCGGA AATTCGCCCAGTCCGGTGACTTGACACGGCATACCAAAATACACACTGG AAGCCAAAAGCCTTTTCAGTGTCGCATATGTATGCGAACTTCAGCCAG AGTAGTGACCTTTCACGGCATATACGGACGCATACGGGTGAGAAACCCT TCGCCTGTGACATTTGCGGGCGAAAGTTTGCATATCATTGGTACCTGAA AAAACATACGAAATACATTTGAGACAAAAAGATGCAGCCCGGGGCTC CGGACCGAAAAAAAAGAGAAAGGTAAACGGCGGGGGAGGATCACGGA CCCTGGTTACATTTAAGGACGTTTTTGTAGACTTCACGAGGGAGGAATG GAAGCTGTTGGACACCGCCCAGCAAATCGTGTATCGAAATGTAATGTTG GAAAATTATAAAAATCTGGTTTCCCTCGGCTACCAATTGACAAAACCAG ACGTCATCCTCAGACTGGAAAAAGGGGAAGAACCTTGGCTTGTCTGA | 3xFLAG-SV40 NLS--ZFP-SV40-NLS-KRAB (DNA Sequence) |
| 936 | ATGGCACCGAAGAAAAAACGCAAAGTTGGTCGAGTACCCGCTGCCATG GCCGAGCGCCCGTTTCAATGCAGAATATGTATGAGGAACTTCTCTAGAA GCGCCAATCTTGCGCGACACATTAGAACTCACACAGGCGAGAAACCTTT CGCCTGTGACATCTGCGGCAGAAAATTTGCGCGAAGTGATAACTTGCGC GAGCACACAAAAATCCATACCGGTTCCCAAAAGCCCTTTCAATGTAGGA TTTGCATGAGGAACTTTTCAAGACCATACACGCTGAGCTCCACATTCG CACGCATACGGGAGAAAACCATTTGCTTGTGACATATGCGGCCGAAA GTTTGCACACCGATCCAACTTGAATAAGCATACCAAAATCCATACGGGG TCTCAGAAACCCTTCCAGTGTCGGATTTGTATGCGAACTTCTCTCAGA GTGGTTCTCTTACGCGCCACATTAGAACCCACACGGGGAAAAGCCATT CGCGTGCGATATCTGTGGCCGGAAATTTGCTACTTCCGCAAATCTTTCTC GACATACAAAGATACATCTTAGACAGAAGGATGCGGCACGGGGCTCCG GACCGAAAAAAAGAGAAAGGTAAACGGCGGGGGAGGATCACGGACC CTGGTTACATTTAAGGACGTTTTTGTAGACTTCACGAGGGAGGAATGGA AGCTGTTGGACACCGCCCAGCAAATCGTGTATCGAAATGTAATGTTGGA AAATTATAAAAATCTGGTTTCCCTCGGCTACCAATTGACAAAACCAGAC GTCATCCTCAGACTGGAAAAAGGGGAAGAACCTTGGCTTGTCTGA | 3xFLAG-SV40 NLS--ZFP-SV40-NLS-KRAB (DNA Sequence) |

TABLE E5-continued eZFP-KRAB fusion proteins

| SEQ ID NOS | Sequence | Description |
|---|---|---|
| 937 | ATGGCACCGAAGAAAAAACGCAAAGTTGGTCGAGTACCCTTGGAGCCC<br>GGTGAAAAACCATATGCCTGTCCAGAGTGTGGAAAAAGTTTTAGCAGA<br>AGCGACGACCTGGTTAGGCATCAACGAACTCACACAGGGGAAAAGCCG<br>TACAAATGTCCTGAATGCGGAAAGTCATTCTCCACTTCAGGTAGCCTCG<br>TGCGACATCAGCGCACACATACTGGCGAAAAACCTTATAAGTGTCCGG<br>AATGCGGCAAGAGTTTTTCTAGAAGTGATAAGTCGTGCGACACCAGCG<br>GACGCACACGGGTGAGAAGCCCTACGCCTGCCCAGAGTGCGGAAAAGTC<br>CTTTAGTAGGTCTGACGAACTGGTCCGGCACCAACGAACCCATACAGGG<br>GAGAAACCCTACAAATGTCCAGAGTGCGGGAAATCATTTTCAACGTCTC<br>ACAGCTTGACGGAACATCAGAGGACCCATACAGGCGAAAAGCCTTACA<br>AATGTCCGGAGTGCGGAAAGTCTTTCAGCCGGGCTGATAATCTCACGGA<br>GCACCAAAGAACCCACACGGGTAAGAAAACCTCTGGCTCCGGACCGAA<br>AAAAAAGAGAAAGGTAAACGGCGGGGAGGATCACGGACCCTGGTTA<br>CATTTAAGGACGTTTTTGTAGACTTCACGAGGGAGGAATGGAAGCTGTT<br>GGACACCGCCCAGCAAATCGTGTATCGAAATGTAATGTTGGAAAATTAT<br>AAAAATCTGGTTTCCCTCGGCTACCAATTGACAAAACCAGACGTCATCC<br>TCAGACTGGAAAAAGGGGAAGAACCTTGGCTTGTCTGA | 3xFLAG-SV40<br>NL--ZFP-<br>SV40-NLS-<br>KRAB (DNA<br>Sequence) |
| 938 | ATGGCACCGAAGAAAAAACGCAAAGTTGGTCGAGTACCCTTGGAGCCG<br>GGAGAAAAGCCATATGCCTGTCCGGAATGCGGCAAAAGCTTTTCAGAA<br>CGGTCCCATTTGCGGGAACATCAGCGCACCCATACCGGAGAAAAGCCTT<br>ACAAGTGTCCCGAGTGTGGTAAGAGCTTTTCAACTTCCCACAGTCTCAC<br>TGAACATCAGCGAACTCACACAGGCGAAAAACCATACAAATGCCCGGA<br>GTGTGGAAAGAGTTTTTCTCAAGCTGGGCACTTGGCCAGCCACCAAAGG<br>ACTCATACGGGCGAGAAACCGTATGCCTGTCCAGAATGCGGGAAATCA<br>TTTTCTACTAGTCATTCCCTTACGGAACATCAGAGAACGCACACCGGG<br>AGAAGCCATACAAGTGTCCGGAGTGCGAAAATCATTCTCCGACCCGG<br>GTCATCTCGTTCGCCATCAGAGGACTCATACTGGAGAGAAACCGTATAA<br>ATGTCCTGAATGCGGGAAGAGCTTTTCTACATCTGGGAACCTTGTGCGG<br>CACCAGCGAACCCACACGGGGAAAAAGACTTCTGGCTCCGGACCGAAA<br>AAAAAGAGAAAGGTAAACGGCGGGGAGGATCACGGACCCTGGTTAC<br>ATTTAAGGACGTTTTTGTAGACTTCACGAGGGAGGAATGGAAGCTGTTG<br>GACACCGCCCAGCAAATCGTGTATCGAAATGTAATGTTGGAAAATTATA<br>AAAATCTGGTTTCCCTCGGCTACCAATTGACAAAACCAGACGTCATCCT<br>CAGACTGGAAAAAGGGGAAGAACCTTGGCTTGTCTGA | 3xFLAG-SV40<br>NLS--ZFP-<br>SV40-NLS-<br>KRAB (DNA<br>Sequence) |
| 939 | ATGGCACCGAAGAAAAAACGCAAAGTTGGTCGAGTACCCCTGGAACCG<br>GGTGAAAAACCCTACGCTTGTCCCGAGTGTGGGAAATCATTCTCAAGGG<br>CAGATAATCTTACGGAACATCAGCGCACACACACGGGGAAAAACCCT<br>ATAAGTGCCCTGAGTGTGGTAAATCATTCTCTACGTCAGGGTCATTGGT<br>GCGCCATCAGAGGACCCATACAGGCGAAAAACCGTATAAGTGCCCCGA<br>ATGCGGTAAAAGCTTCAGCAGAAAAGATAACTTGAAAAATCACCAACG<br>CACTCACACGGGAGAAAAACCGTACGCATGCCCGGAGTGCGGCAAGAG<br>TTTCAGTCAGAGTAGCTCACTTGTTCGCCACCAAAGAACCCACACAGGC<br>GAAAAGCCCTACAAGTGTCCTGAATGTGGAAAGAGTTTCAGTCGAAGT<br>GATAAATTGGTTAGGCACCAAAGAACACACACTGGAGAGAAACCGTAC<br>AAGTGTCCAGAATGTGGCAAGTCTTTTTTCTGATTCTGGAAATTTGCGCGT<br>CCATCAAAGGACTCATACTGGGAAAAAGACGTCCGGCTCCGGACCGAA<br>AAAAAAGAGAAAGGTAAACGGCGGGGAGGATCACGGACCCTGGTTA<br>CATTTAAGGACGTTTTTGTAGACTTCACGAGGGAGGAATGGAAGCTGTT<br>GGACACCGCCCAGCAAATCGTGTATCGAAATGTAATGTTGGAAAATTAT<br>AAAAATCTGGTTTCCCTCGGCTACCAATTGACAAAACCAGACGTCATCC<br>TCAGACTGGAAAAAGGGGAAGAACCTTGGCTTGTCTGA | 3xFLAG-SV40<br>NLS--ZFP-<br>SV40-NLS-<br>KRAB (DNA<br>Sequence) |
| 940 | ATGGCACCGAAGAAAAAACGCAAAGTTGGTCGAGTACCCCTCGAACCA<br>GGGGAAAAGCCATACGCTTGCCCCGAGTGTGGAAAATCTTTCTCTCAGT<br>CAAGCTCCCTTGTCAGACACCAGAGAACCCATACGGGTGAGAAACCAT<br>ACAAGTGCCCAGAGTGCGGCAAAAGCTTCAGTCAGAGTGGCGATCTGC<br>GCCGGCATCAAAGAACTCACACTGGAGAAAAGCCCTATAAGTGCCCCG<br>AATGTGGAAAGAGTTTTTCCAGGAGTGACGAAAGAAAGAGACACCAGC<br>GGACTCACACCGGCGAGAAACCATACGCATGCCCCGAGTGCGGAAAAA<br>GTTTTTCCCACCGCACAACCCTTACCAATCATCAACGCACGCACACAGG<br>GGAGAAACCCTACAAGTGCCCGGAGTGTGGCAAGTCATTCAGCCGAAG<br>TGACCACCTCACTAACCACCAAAGGACTCACACAGGAGAAAAACCCTA<br>CAAATGTCCGGAGTGCGGAAATCTTTTTCCACGTCCGGTGAGCTGGTC<br>CGCCATCAACGAACCCATACTGGTAAAAAAACTAGCGGCTCCGGACCG<br>AAAAAAAAGAGAAAGGTAAACGGCGGGGAGGATCACGGACCCTGGT<br>TACATTTAAGGACGTTTTTGTAGACTTCACGAGGGAGGAATGGAAGCTG<br>TTGGACACCGCCCAGCAAATCGTGTATCGAAATGTAATGTTGGAAAATT<br>ATAAAAATCTGGTTTCCCTCGGCTACCAATTGACAAAACCAGACGTCAT<br>CCTCAGACTGGAAAAAGGGGAAGAACCTTGGCTTGTCTGA | 3xFLAG-SV40<br>NLS--ZFP-<br>SV40-NLS-<br>KRAB (DNA<br>Sequence) |

TABLE E5-continued eZFP-KRAB fusion proteins

| SEQ ID NOS | Sequence | Description |
|---|---|---|
| 941 | ATGGCACCGAAGAAAAAACGCAAAGTTGGTCGAGTACCCCTGGAACCC GGGGAGAAGCCGTACGCTTGCCCAGAGTGCGGAAAGAGCTTCTCTCAG AGCGGAGACCTTAGACGCCACCAGCGAACCCACACCGGCGAAAAACCG TATAAATGCCCGGAATGCGGCAAGAGTTTTAGTCGGTCCGATGAGCGA AAGAGGCATCAACGAACCCATACGGGAGAGAAACCCTACAAGTGCCCT GAGTGTGGTAAGTCATTTTCCCACAGAACGACGTTGACGAATCACCAGA GAACCCATACGGGTGAGAAACCTTACGCTTGCCCGGAGTGCGGCAAAA GCTTCAGCCGGAGTGATCACTTGACCAATCATCAGAGGACACACACGG GTGAGAAGCCCTACAAATGTCCCGAATGCGGCAAGTCTTTCTCAACGTC AGGCGAACTCGTCCGGCACCAGCGAACACATACGGGAGAAAAGCCGTA CAAATGTCCGGAATGCGGAAAGTCATTTTCACGGTCAGATGACTTGGTG CGACACCAGCGCACTCACACAGGCAAGAAGACCTCAGGCTCCGGACCG AAAAAAAGAGAAAGGTAAACGGCGGGGGAGGATCACGGACCCTGGT TACATTTAAGGACGTTTTTGTAGACTTCACGAGGGAGGAATGGAAGCTG TTGGACACCGCCCAGCAAATCGTGTATCGAAATGTAATGTTGGAAAATT ATAAAAATCTGGTTTCCCTCGGCTACCAATTGACAAAACCAGACGTCAT CCTCAGACTGGAAAAAGGGGAAGAACCTTGGCTTGTCTGA | 3xFLAG-SV40 NLS--ZFP-SV40-NLS-KRAB (DNA Sequence) |
| 942 | ATGGCACCGAAGAAAAAACGCAAAGTTGGTCGAGTACCCCTGGAGCCT GGTGAGAAGCCGTATGCATGTCCTGAGTGTGGGAAGTCATTTAGTCAGA GGGCCCACTTGGAACGACACCAAAGGACCCACACTGGTGAAAAACCCT ACAAATGCCCAGAGTGTGGTAAGTCTTTTTCACAGCTGGCCCACCTGAG AGCACACCAGCGAACTCATACGGGCGAGAAACCATACAAGTGTCCAGA GTGCGGAAAGTCATTCTCAGATCCCGGCCACTTGGTGCGACATCAGAGA ACGCACACAGGGGAGAAGCCTTATGCTTGCCCGGAATGCGGGAAGTCT TTCAGCCGCCGAAGTGCTTGTCGAAGGCACCAACGGACCCATACCGGTG AGAAACCATATAAGTGCCCAGAGTGTGGAAAGAGTTTTAGTCGATCCG ATCACCTGACTACGCACCAGCGGACGCACACAGGAGAGAAACCGTATA AGTGCCCTGAATGCGGTAAGAGCTTCTCTCAATCAAGCTCACTGGTTAG GCACCAACGCACTCATACCGGCAAGAAGACGTCAGGCTCCGGACCGAA AAAAAAGAGAAAGGTAAACGGCGGGGGAGGATCACGGACCCTGGTTA CATTTAAGGACGTTTTTGTAGACTTCACGAGGGAGGAATGGAAGCTGTT GGACACCGCCCAGCAAATCGTGTATCGAAATGTAATGTTGGAAAATTAT AAAAATCTGGTTTCCCTCGGCTACCAATTGACAAAACCAGACGTCATCC TCAGACTGGAAAAAGGGGAAGAACCTTGGCTTGTCTGA | 3xFLAG-SV40 NLS--ZFP-SV40-NLS-KRAB (DNA Sequence) |
| 943 | ATGGCACCGAAGAAAAAACGCAAAGTTGGTCGAGTACCCCTTGAGCCG GGGGAAAAGCCTTATGCTTGCCCAGAGTGTGGCAAGAGCTTCTCCCAAA GTTCAAACCTCGTCCGACACCAAAGGACTCACACGGGCGAAAAACCGT ATAAATGCCCCGAGTGCGGAAAGTCATTTTCCAGGTCCGACGATCTGGT CCGCCACCAGCGCACTCATACGGGGAAAAGCCCTATAAGTGCCCTGA GTGCGGCAAGAGCTTCTCAACTCACCTGGATCTCATTCGCCATCAACGC ACACATACAGGGGAGAAGCCTTACGCTTGTCCAGAGTGCGGCAAGTCTT TCAGTACGAGCGGAAACCTGACGAACACCAGCGAACCCACACGGGCG AGAAGCCATATAAATGTCCCGAATGTGGAAAATCATTCTCTCGCCGATC TGCGTGCCGCGGCATCAGAGGACACATACCGGAGAAAAGCCGTACAA ATGCCCCGAGTGTGGAAAATCCTTTAGCAGAAATGATACACTTACCGAG CATCAGAGGACGCACACTGGAAAAAGACATCTGGCTCCGGACCGAAA AAAAAGAGAAAGGTAAACGGCGGGGGAGGATCACGGACCCTGGTTAC ATTTAAGGACGTTTTTGTAGACTTCACGAGGGAGGAATGGAAGCTGTTG GACACCGCCCAGCAAATCGTGTATCGAAATGTAATGTTGGAAAATTATA AAAATCTGGTTTCCCTCGGCTACCAATTGACAAAACCAGACGTCATCCT CAGACTGGAAAAAGGGGAAGAACCTTGGCTTGTCTGA | 3xFLAG-SV40 NLS--ZFP-SV40-NLS-KRAB (DNA Sequence) |
| 944 | MAPKKKRKVGRVPAAMAERPFQCRICMRNFSSEADRSRHIRTHTGEKPFA CDICGRKFADRSNLTRHTKIHTGSQKPFQCRICMRNFSQSSDLSRHIRTHTG EKPFACDICGRKFAYHWYLKKHTKIHTGSQKPFQCRICMRNFSRSDSLSVHI RTHTGEKPFACDICGRKFAQNANRKTHTKIHLRQKDAARGSGPKKKRKVN GGGGSRTLVTFKDVFVDFTREEWKLLDTAQQIVYRNVMLENYKNLVSLG YQLTKPDVILRLEKGEEPWLV | 3xFLAG-SV40 NLS--ZFP-SV40-NLS-KRAB fusion (AA Sequence) |
| 945 | MAPKKKRKVGRVPAAMAERPFQCRICMRNFSRSDVLSTHIRTHTGEKPFA CDICGKKFADNSSRTRHTKIHTGSQKPFQCRICMRNFSRPYTLRLHIRTHTG EKPFACDICGRKFADSSHRTRHTKIHTGSQKPFQCRICMRNFSRSDHLSQHI RTHTGEKPFACDICGRKFADSSHRTRHTKIHLRQKDAARGSGPKKKRKVN GGGGSRTLVTFKDVFVDFTREEWKLLDTAQQIVYRNVMLENYKNLVSLG YQLTKPDVILRLEKGEEPWLV | 3xFLAG-SV40 NLS--ZFP-SV40-NLS-KRAB fusion (AA Sequence) |

TABLE E5-continued eZFP-KRAB fusion proteins

| SEQ ID NOS | Sequence | Description |
|---|---|---|
| 946 | MAPKKKRKVGRVPAAMAERPFQCRICMRNFSRSDHLSQHIRTHTGEKPFA<br>CDICGRKFAQSADRTKHTKIHTGSQKPFQCRICMRNFSRSDHLSQHIRTHTG<br>EKPFACDICGRKFARRSDLKRHTKIHTGSQKPFQCRICMRNFSRSDHLSRHI<br>RTHTGEKPFACDICGRKFAQSSDLRRHTKIHLRQKDAARGSGPKKKRKVN<br>GGGGSRTLVTFKDVFVDFTREEWKLLDTAQQIVYRNVMLENYKNLVSLG<br>YQLTKPDVILRLEKGEEPWLV | 3xFLAG-SV40<br>NLS--ZFP-<br>SV40-NLS-<br>KRAB fusion<br>(AA Sequence) |
| 947 | MAPKKKRKVGRVPAAMAERPFQCRICMRNFSRSDNLSEHIRTHTGEKPFA<br>CDICGRKFATSSNRKTHTKIHTGSQKPFQCRICMRNFSDRSHLTRHIRTHTG<br>EKPFACDICGRKFARSDALTQHTKIHTGSQKPFQCRICMRNFSDRSALARHI<br>RTHTGEKPFACDICGRKFARRFTLSKHTKIHLRQKDAARGSGPKKKRKVNG<br>GGGSRTLVTFKDVFVDFTREEWKLLDTAQQIVYRNVMLENYKNLVSLGY<br>QLTKPDVILRLEKGEEPWLV | 3xFLAG-SV40<br>NLS--ZFP-<br>SV40-NLS-<br>KRAB fusion<br>(AA Sequence) |
| 948 | MAPKKKRKVGRVPAAMAERPFQCRICMRNFSRSDHLSEHIRTHTGEKPFA<br>CDICGRKFAQYSGRYYHTKIHTGSQKPFQCRICMRNFSHGQTLNEHIRTHT<br>GEKPFACDICGRKFAQSGNLARHTKIHTGSQKPFQCRICMRNFSRSDSLLRH<br>IRTHTGEKPFACDICGRKFACREYRGKHTKIHLRQKDAARGSGPKKKRKVN<br>GGGGSRTLVTFKDVFVDFTREEWKLLDTAQQIVYRNVMLENYKNLVSLG<br>YQLTKPDVILRLEKGEEPWLV | 3xFLAG-SV40<br>NLS--ZFP-<br>SV40-NLS-<br>KRAB fusion<br>(AA Sequence) |
| 949 | MAPKKKRKVGRVPAAMAERPFQCRICMRNFSQSANRTTHIRTHTGEKPFA<br>CDICGRKFARSANLTRHTKIHTGSQKPFQCRICMRNFSRSDVLSEHIRTHTG<br>EKPFACDICGRKFATSGHLSRHTKIHTGSQKPFQCRICMRNFSQSSDLSRHIR<br>THTGEKPFACDICGRKFAQWSTRKRHTKIHLRQKDAARGSGPKKKRKVNG<br>GGGSRTLVTFKDVFVDFTREEWKLLDTAQQIVYRNVMLENYKNLVSLGY<br>QLTKPDVILRLEKGEEPWLV | 3xFLAG-SV40<br>NLS--ZFP-<br>SV40-NLS-<br>KRAB fusion<br>(AA Sequence) |
| 950 | MAPKKKRKVGRVPAAMAERPFQCRICMRNFSQSGNLARHIRTHTGEKPFA<br>CDICGRKFAATCCLAHHTKIHTGSQKPFQCRICMRNFSRWQYLPTHIRTHA<br>GEKPFACDICGRKFADRSALARHTKIHTGSQKPFQCRICMRNFSRSDNLSEH<br>IRTHTGEKPFACDICGRKFAKRCNLRCHTKIHLRQKDAARGSGPKKKRKVN<br>GGGGSRTLVTFKDVFVDFTREEWKLLDTAQQIVYRNVMLENYKNLVSLG<br>YQLTKPDVILRLEKGEEPWLV | 3xFLAG-SV40<br>NLS--ZFP-<br>SV40-NLS-<br>KRAB fusion<br>(AA Sequence) |
| 951 | MAPKKKRKVGRVPAAMAERPFQCRICMRNFSNPANLTRHIRTHTGEKPFA<br>CDICGRKFAQNATRTKHTKIHTGSQKPFQCRICMRNFSQSGHLARHIRTHT<br>GEKPFACDICGRKFANRHDRAKHTKIHTGSQKPFQCRICMRNFSRSDHLSE<br>HIRTHTGEKPFACDICGRKFAQRRSRYKHTKIHLRQKDAARGSGPKKKRKV<br>NGGGGSRTLVTFKDVFVDFTREEWKLLDTAQQIVYRNVMLENYKNLVSL<br>GYQLTKPDVILRLEKGEEPWLV | 3xFLAG-SV40<br>NLS--ZFP-<br>SV40-NLS-<br>KRAB fusion<br>(AA Sequence) |
| 952 | MAPKKKRKVGRVPAAMAERPFQCRICMRNFSQSSDLSRHIRTHTGEKPFAC<br>DICGRKFAHRSTRNRHTKIHTGSQKPFQCRICMRNFSRSDVLSAHIRTHTGE<br>KPFACDICGRKFADSRTRKNHTKIHTGSQKPFQCRICMRNFSQSGSLTRHIR<br>THTGEKPFACDICGRKFADQSGLAHHTKIHLRQKDAARGSGPKKKRKVNG<br>GGGSRTLVTFKDVFVDFTREEWKLLDTAQQIVYRNVMLENYKNLVSLGY<br>QLTKPDVILRLEKGEEPWLV | 3xFLAG-SV40<br>NLS--ZFP-<br>SV40-NLS-<br>KRAB fusion<br>(AA Sequence) |
| 953 | MAPKKKRKVGRVPAAMAERPFQCRICMRNFSQNPAQWRHIRTHTGEKPFA<br>CDICGRKFARSADLSRHTKIHTGSQKPFQCRICMRNFSTSGSLSRHIRTHTGE<br>KPFACDICGRKFARSDHLSRHTKIHTGSQKPFQCRICMRNFSRSDSLLRHIRT<br>HTGEKPFACDICGRKFAQSYDRFQHTKIHLRQKDAARGSGPKKKRKVNGG<br>GGSRTLVTFKDVFVDFTREEWKLLDTAQQIVYRNVMLENYKNLVSLGYQL<br>TKPDVILRLEKGEEPWLV | 3xFLAG-SV40<br>NLS--ZFP-<br>SV40-NLS-<br>KRAB fusion<br>(AA Sequence) |
| 954 | MAPKKKRKVGRVPAAMAERPFQCRICMRNFSTSGSLSRHIRTHTGEKPFAC<br>DICGRKFARSDHLSRHTKIHTGSQKPFQCRICMRNFSRSDSLLRHIRTHTGE<br>KPFACDICGRKFAQSYDRFQHTKIHTGSQKPFQCRICMRNFSRSDNLSTHIR<br>THTGEKPFACDICGRKFADNRDRIKHTKIHLRQKDAARGSGPKKKRKVNG<br>GGGSRTLVTFKDVFVDFTREEWKLLDTAQQIVYRNVMLENYKNLVSLGY<br>QLTKPDVILRLEKGEEPWLV | 3xFLAG-SV40<br>NLS--ZFP-<br>SV40-NLS-<br>KRAB fusion<br>(AA Sequence) |
| 955 | MAPKKKRKVGRVPAAMAERPFQCRICMRNFSDRSNLSRHIRTHTGEKPFA<br>CDICGRKFALRQNLIMHTKIHTGSQKPFQCRICMRNFSERGTLARHIRTHTG<br>EKPFACDICGRKFARSDALTQHTKIHTGSQKPFQCRICMRNFSRSDSLSQHI<br>RTHTGEKPFACDICGRKFARKADRTRHTKIHLRQKDAARGSGPKKKRKVN<br>GGGGSRTLVTFKDVFVDFTREEWKLLDTAQQIVYRNVMLENYKNLVSLG<br>YQLTKPDVILRLEKGEEPWLV | 3xFLAG-SV40<br>NLS--ZFP-<br>SV40-NLS-<br>KRAB fusion<br>(AA Sequence) |

TABLE E5-continued eZFP-KRAB fusion proteins

| SEQ ID NOS | Sequence | Description |
|---|---|---|
| 956 | MAPKKKRKVGRVPAAMAERPFQCRICMRNFSQYCCLTNHIRTHTGEKPFA<br>CDICGRKFATSGNLTRHTKIHTGSQKPFQCRICMRNFSQSSDLSRHIRTHTG<br>EKPFACDICGRKFAFRYYLKRHTKIHTGSQKPFQCRICMRNFSQSGDLTRHI<br>RTHTGEKPFACDICGRKFADKGNLTKHTKIHLRQKDAARGSGPKKKRKVN<br>GGGGSRTLVTFKDVFVDFTREEWKLLDTAQQIVYRNVMLENYKNLVSLG<br>YQLTKPDVILRLEKGEEPWLV | 3xFLAG-SV40 NLS--ZFP-SV40-NLS-KRAB fusion (AA Sequence) |
| 957 | MAPKKKRKVGRVPAAMAERPFQCRICMRNFSTSGSLSRHIRTHTGEKPFAC<br>DICGRKFARSDNLTTHTKIHTGSQKPFQCRICMRNFSQSGNLARHIRTHTGE<br>KPFACDICGRKFADRTTLMRHTKIHTGSQKPFQCRICMRNFSQSGHLARHIR<br>THTGEKPFACDICGRKFAQLTHLNSHTKIHLRQKDAARGSGPKKKRKVNG<br>GGGSRTLVTFKDVFVDFTREEWKLLDTAQQIVYRNVMLENYKNLVSLGY<br>QLTKPDVILRLEKGEEPWLV | 3xFLAG-SV40 NLS--ZFP-SV40-NLS-KRAB fusion (AA Sequence) |
| 958 | MAPKKKRKVGRVPAAMAERPFQCRICMRNFSIKHDLHRHIRTHTGEKPFA<br>CDICGRKFARSANLTRHTKIHTGSQKPFQCRICMRNFSRSDNLARHIRTHTG<br>EKPFACDICGRKFAQNVSRPRHTKIHTGSQKPFQCRICMRNFSRSDDLSKHI<br>RTHTGEKPFACDICGRKFADSSHRTRHTKIHLRQKDAARGSGPKKKRKVN<br>GGGGSRTLVTFKDVFVDFTREEWKLLDTAQQIVYRNVMLENYKNLVSLG<br>YQLTKPDVILRLEKGEEPWLV | 3xFLAG-SV40 NLS--ZFP-SV40-NLS-KRAB fusion (AA Sequence) |
| 959 | MAPKKKRKVGRVPAAMAERPFQCRICMRNFSRSDNLARHIRTHTGEKPFA<br>CDICGRKFAQNVSRPRHTKIHTGSQKPFQCRICMRNFSRSDDLSKHIRTHTG<br>EKPFACDICGRKFADSSHRTRHTKIHTGSQKPFQCRICMRNFSTSSNRKTHIR<br>THTGEKPFACDICGRKFAAQWTRACHTKIHLRQKDAARGSGPKKKRKVNG<br>GGGSRTLVTFKDVFVDFTREEWKLLDTAQQIVYRNVMLENYKNLVSLGY<br>QLTKPDVILRLEKGEEPWLV | 3xFLAG-SV40 NLS--ZFP-SV40-NLS-KRAB fusion (AA Sequence) |
| 960 | MAPKKKRKVGRVPAAMAERPFQCRICMRNFSRSDDLSKHIRTHTGEKPFA<br>CDICGRKFADSSHRTRHTKIHTGSQKPFQCRICMRNFSTSSNRKTHIRTHTG<br>EKPFACDICGRKFAAQWTRACHTKIHTGSQKPFQCRICMRNFSRKQTRTTH<br>IRTHTGEKPFACDICGRKFAHRSSLRRHTKIHLRQKDAARGSGPKKKRKVN<br>GGGGSRTLVTFKDVFVDFTREEWKLLDTAQQIVYRNVMLENYKNLVSLG<br>YQLTKPDVILRLEKGEEPWLV | 3xFLAG-SV40 NLS--ZFP-SV40-NLS-KRAB fusion (AA Sequence) |
| 961 | MAPKKKRKVGRVPAAMAERPFQCRICMRNFSQSAHRKNHIRTHTGEKPFA<br>CDICGRKFATSSNRKTHTKIHTGSQKPFQCRICMRNFSRSDNLSAHIRTHTG<br>EKPFACDICGRKFARNNDRKTHTKIHTGSQKPFQCRICMRNFSTSGSLSRHI<br>RTHTGEKPFACDICGRKFAQAGHLAKHTKIHLRQKDAARGSGPKKKRKVN<br>GGGGSRTLVTFKDVFVDFTREEWKLLDTAQQIVYRNVMLENYKNLVSLG<br>YQLTKPDVILRLEKGEEPWLV | 3xFLAG-SV40 NLS--ZFP-SV40-NLS-KRAB fusion (AA Sequence) |
| 962 | MAPKKKRKVGRVPAAMAERPFQCRICMRNFSRSDHLSQHIRTHTGEKPFA<br>CDICGRKFAASSTRTKHTKIHTGSQKPFQCRICMRNFSRSDDLTRHIRTHTG<br>EKPFACDICGRKFAQKSNLSSHTKIHTGSQKPFQCRICMRNFSQSANRTTHI<br>RTHTGEKPFACDICGRKFAQNATRTKHTKIHLRQKDAARGSGPKKKRKVN<br>GGGGSRTLVTFKDVFVDFTREEWKLLDTAQQIVYRNVMLENYKNLVSLG<br>YQLTKPDVILRLEKGEEPWLV | 3xFLAG-SV40 NLS--ZFP-SV40-NLS-KRAB fusion (AA Sequence) |
| 963 | MAPKKKRKVGRVPAAMAERPFQCRICMRNFSRSDTLSEHIRTHTGEKPFAC<br>DICGRKFARRWTLVGHTKIHTGSQKPFQCRICMRNFSDRSNLSRHIRTHTGE<br>KPFACDICGRKFAQSGDLTRHTKIHTGSQKPFQCRICMRNFSQSSDLSRHIR<br>THTGEKPFACDICGRKFAYHWYLKKHTKIHLRQKDAARGSGPKKKRKVN<br>GGGGSRTLVTFKDVFVDFTREEWKLLDTAQQIVYRNVMLENYKNLVSLG<br>YQLTKPDVILRLEKGEEPWLV | 3xFLAG-SV40 NLS--ZFP-SV40-NLS-KRAB fusion (AA Sequence) |
| 964 | MAPKKKRKVGRVPAAMAERPFQCRICMRNFSRSANLARHIRTHTGEKPFA<br>CDICGRKFARSDNLREHTKIHTGSQKPFQCRICMRNFSRPYTLRLHIRTHTG<br>EKPFACDICGRKFAHRSNLNKHTKIHTGSQKPFQCRICMRNFSQSGSLTRHI<br>RTHTGEKPFACDICGRKFATSANLSRHTKIHLRQKDAARGSGPKKKRKVN<br>GGGGSRTLVTFKDVFVDFTREEWKLLDTAQQIVYRNVMLENYKNLVSLG<br>YQLTKPDVILRLEKGEEPWLV | 3xFLAG-SV40 NLS--ZFP-SV40-NLS-KRAB fusion (AA Sequence) |
| 965 | MAPKKKRKVGRVPLEPGEKPYACPECGKSFSRSDDLVRHQRTHTGEKPYK<br>CPECGKSFSTSGSLVRHQRTHTGEKPYKCPECGKSFSRSDKLVRHQRTHTG<br>EKPYACPECGKSFSRSDELVRHQRTHTGEKPYKCPECGKSFSTSHSLTEHQR<br>THTGEKPYKCPECGKSFSRADNLTEHQRTHTGKKTSGSGPKKKRKVNGGG<br>GSRTLVTFKDVFVDFTREEWKLLDTAQQIVYRNVMLENYKNLVSLGYQLT<br>KPDVILRLEKGEEPWLV | 3xFLAG-SV40 NLS--ZFP-SV40-NLS-KRAB fusion (AA Sequence) |

TABLE E5-continued eZFP-KRAB fusion proteins

| SEQ ID NOS | Sequence | Description |
|---|---|---|
| 966 | MAPKKKRKVGRVPLEPGEKPYACPECGKSFSERSHLREHQRTHTGEKPYK<br>CPECGKSFSTSHSLTEHQRTHTGEKPYKCPECGKSFSQAGHLASHQRTHTG<br>EKPYACPECGKSFSTSHSLTEHQRTHTGEKPYKCPECGKSFSDPGHLVRHQ<br>RTHTGEKPYKCPECGKSFSTSGNLVRHQRTHTGKKTSGSGPKKKRKVNGG<br>GGSRTLVTFKDVFVDFTREEWKLLDTAQQIVYRNVMLENYKNLVSLGYQL<br>TKPDVILRLEKGEEPWLV | 3xFLAG-SV40<br>NLS--ZFP-<br>SV40-NLS-<br>KRAB fusion<br>(AA Sequence) |
| 967 | MAPKKKRKVGRVPLEPGEKPYKCPECGKSFSRADNLTEHQRTHTGEKPYK<br>CPECGKSFSTSGSLVRHQRTHTGEKPYKCPECGKSFSRKDNLKNHQRTHTG<br>EKPYKCPECGKSFSQSSSLVRHQRTHTGEKPYKCPECGKSFSRSDKLVRHQ<br>RTHTGEKPYKCPECGKSFSDSGNLRVHQRTHTGKKTSGSGPKKKRKVNGG<br>GGSRTLVTFKDVFVDFTREEWKLLDTAQQIVYRNVMLENYKNLVSLGYQL<br>TKPDVILRLEKGEEPWLV | 3xFLAG-SV40<br>NLS--ZFP-<br>SV40-NLS-<br>KRAB fusion<br>(AA Sequence) |
| 968 | MAPKKKRKVGRVPLEPGEKPYACPECGKSFSQSSSLVRHQRTHTGEKPYK<br>CPECGKSFSQSGDLRRHQRTHTGEKPYKCPECGKSFSRSDERKRHQRTHTG<br>EKPYACPECGKSFSHRTTLTNHQRTHTGEKPYKCPECGKSFSRSDHLTNHQ<br>RTHTGEKPYKCPECGKSFSTSGELVRHQRTHTGKKTSGSGPKKKRKVNGG<br>GGSRTLVTFKDVFVDFTREEWKLLDTAQQIVYRNVMLENYKNLVSLGYQL<br>TKPDVILRLEKGEEPWLV | 3xFLAG-SV40<br>NLS--ZFP-<br>SV40-NLS-<br>KRAB fusion<br>(AA Sequence) |
| 969 | MAPKKKRKVGRVPLEPGEKPYACPECGKSFSQSGDLRRHQRTHTGEKPYK<br>CPECGKSFSRSDERKRHQRTHTGEKPYKCPECGKSFSHRTTLTNHQRTHTG<br>EKPYACPECGKSFSRSDHLTNHQRTHTGEKPYKCPECGKSFSTSGELVRHQ<br>RTHTGEKPYKCPECGKSFSRSDDLVRHQRTHTGKKTSGSGPKKKRKVNGG<br>GGSRTLVTFKDVFVDFTREEWKLLDTAQQIVYRNVMLENYKNLVSLGYQL<br>TKPDVILRLEKGEEPWLV | 3xFLAG-SV40<br>NLS--ZFP-<br>SV40-NLS-<br>KRAB fusion<br>(AA Sequence) |
| 970 | MAPKKKRKVGRVPLEPGEKPYACPECGKSFSQRAHLERHQRTHTGEKPYK<br>CPECGKSFSQLAHLRAHQRTHTGEKPYKCPECGKSFSDPGHLVRHQRTHTG<br>EKPYACPECGKSFSRRSACRRHQRTHTGEKPYKCPECGKSFSRSDHLTTHQ<br>RTHTGEKPYKCPECGKSFSQSSSLVRHQRTHTGKKTSGSGPKKKRKVNGG<br>GGSRTLVTFKDVFVDFTREEWKLLDTAQQIVYRNVMLENYKNLVSLGYQL<br>TKPDVILRLEKGEEPWLV | 3xFLAG-SV40<br>NLS--ZFP-<br>SV40-NLS-<br>KRAB fusion<br>(AA Sequence) |
| 971 | MAPKKKRKVGRVPLEPGEKPYACPECGKSFSQSSNLVRHQRTHTGEKPYK<br>CPECGKSFSRSDDLVRHQRTHTGEKPYKCPECGKSFSTHLDLIRHQRTHTG<br>EKPYACPECGKSFSTSGNLTEHQRTHTGEKPYKCPECGKSFSRRSACRRHQ<br>RTHTGEKPYKCPECGKSFSRNDTLTEHQRTHTGKKTSGSGPKKKRKVNGG<br>GGSRTLVTFKDVFVDFTREEWKLLDTAQQIVYRNVMLENYKNLVSLGYQL<br>TKPDVILRLEKGEEPWLV | 3xFLAG-SV40<br>NLS--ZFP-<br>SV40-NLS-<br>KRAB fusion<br>(AA Sequence) |

Figure 30:
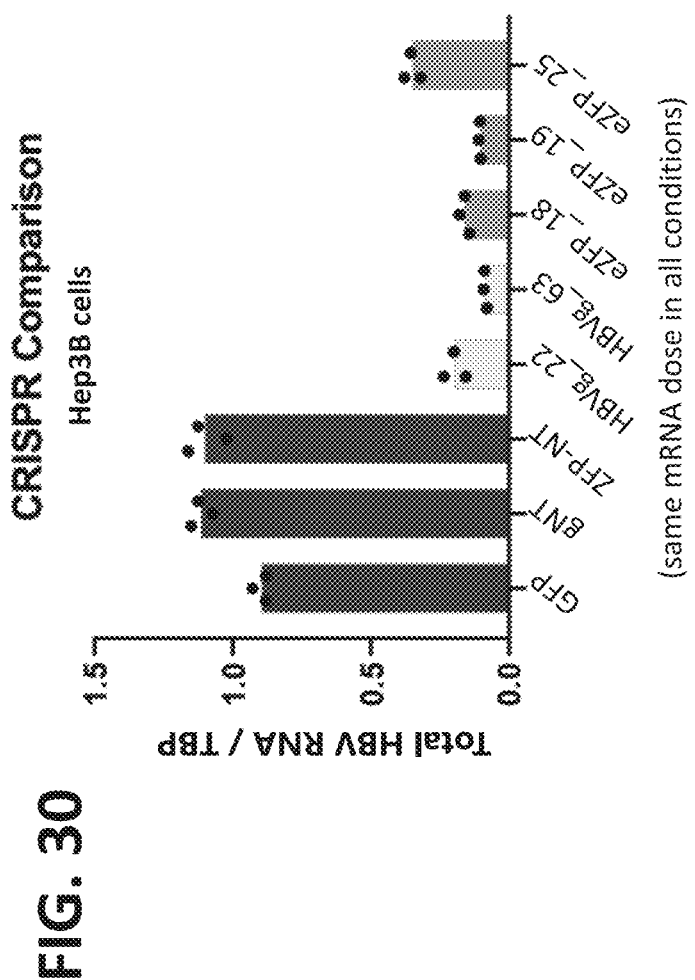
FIG. 30 shows a preliminary comparison between repression induced by ZFP-KRAB fusion proteins and dCas9-KRAB fusion protein in combination with gRNAs in Hep3B cells.

Example 9: Comparison Between Repression Induced by dSpCas9-KRAB and eZFP-KRAB Fusion Proteins To compare the level of transcriptional repression induced by the eZFP-KRAB fusion proteins with the dSpCas9-KRAB and gRNA system, Hep3B cells were transfected via lipofectamine with mRNA encoding the most effective eZFP-KRAB fusion proteins set forth in SEQ ID NOs:961, 962, or 968, and mRNA encoding dSpCas9-KRAB (SEQ ID NO: 595) with either gRNA HBVg_22 (SEQ ID NO:412) or HBVg_63 (SEQ ID NO: 453). Non-targeting (NT) gRNA, GFP, and ZFP-NT (non-targeting eZFP comprising a KRAB domain) were included as negative controls. The cells expressing the eZFP-KRAB fusion or the dSpCas9-KRAB proteins were assessed by qPCR for HBV RNA levels after three days. FIG. 30 shows a preliminary comparison between repression induced by i) HBVg_22 (SEQ ID NO: 412) in combination with dSpCas9-KRAB fusion protein (SEQ ID NO: 595), ii) HBVg_63 (SEQ ID NO: 453) in combination with dSpCas9-KRAB fusion protein (SEQ ID NO: 595), and iii) the most effective eZFP-KRAB fusion proteins set forth in SEQ IID NOs: 961, 962, and 968. As shown in FIG. 30 the ZFP-KRAB fusion proteins induced transcriptional repression that was comparable to the repression mediated by the dSpCas9-KRAB fusion proteins.

Figure 31A:
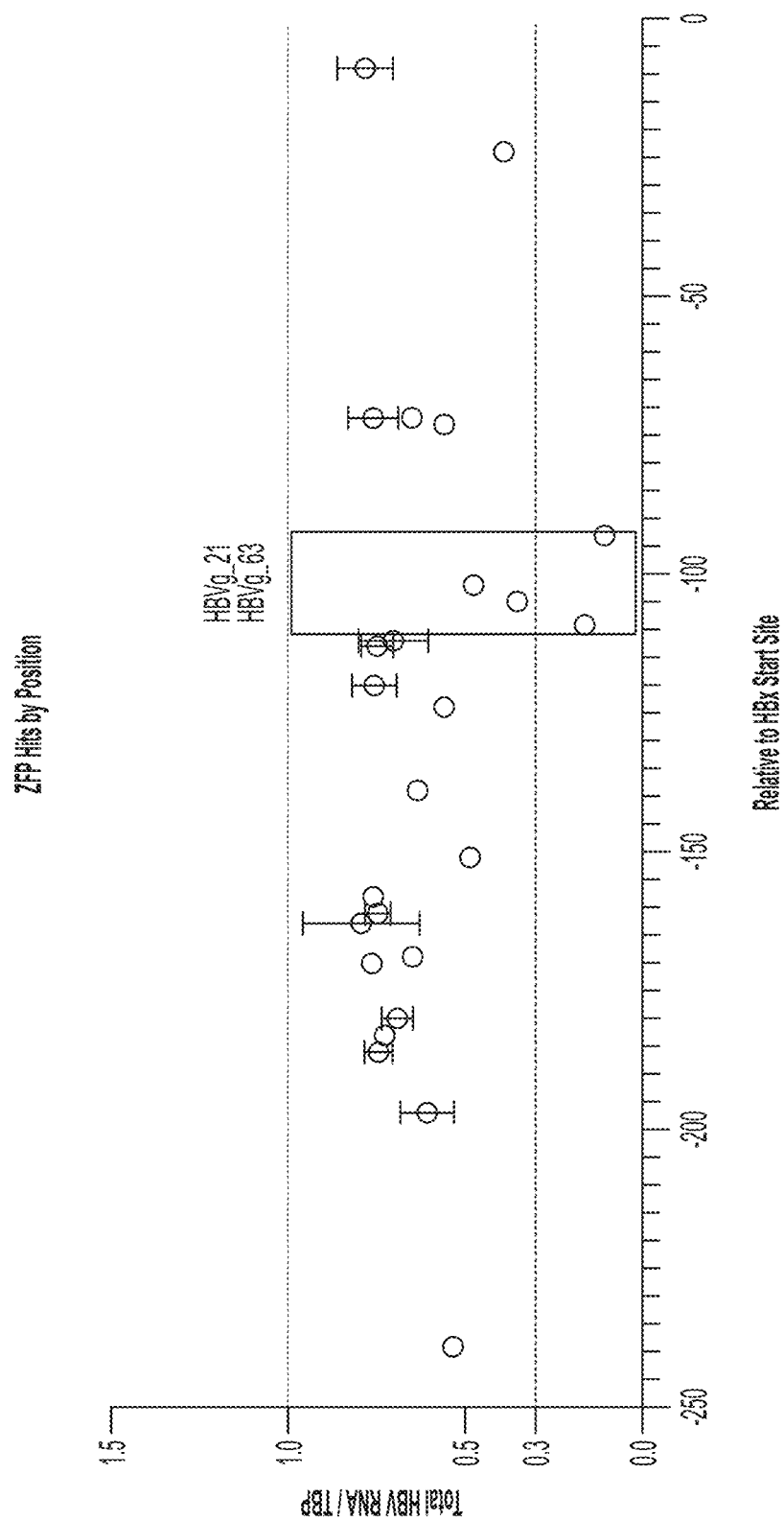
FIG. 31A-FIG. 31B show the targeting positions of each ZFP along the X-promoter (HBx) site. The highlighted region in FIG. 31A represents the region within the HBx promoter that is targeted by the most effective gRNAs (HBVg_22 and HBVg_63) as well as the most effective ZFP-KRAB fusion proteins (eZFP_18, eZFP_19, and eZFP_25).
Figure 31B:
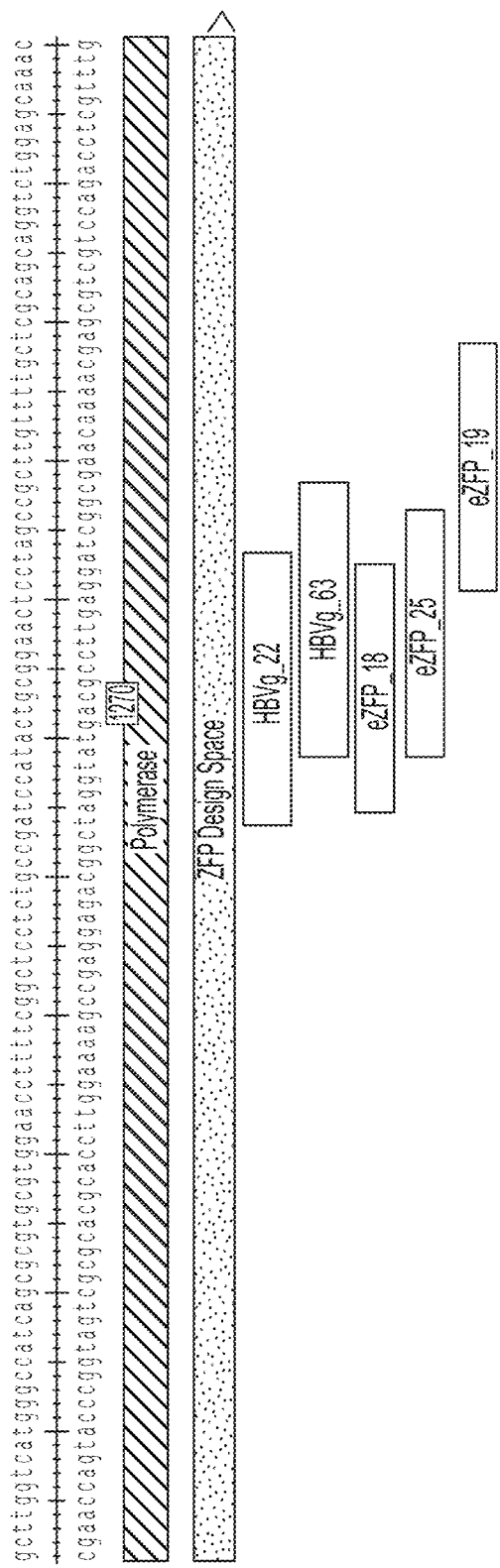

FIGS. 31A and 31B depict the targeting positions of each eZFP along the HB X-promoter (HBx) start site. As shown in the FIGS. 31A-31B, the most effective eZFPs (set forth in SEQ ID NOs: 961, 962, and 968) targeted the same general region targeted by the gRNAs HBVg_22 (SEQ ID NO: 412) and HBVg_63 (SEQ ID NO: 453). These data show that significant repression was achieved using either DNA-binding domains. These results demonstrate the robustness of targeting the positions between 1250 base pairs (bp) to 1374 bp, and particulary the region 1260 bp to 1300 bp, of the HBV genome to induce transcriptional repression of HBV.

Example 10: Strong Repression of cccDNA Achieved with the eZFP-KRAB Fusions in the HepG2.NTCP True Infection Model The 28 eZFP-KRAB fusion proteins identified in Example 8 were screened in the HepG2.NTCP true infection model. HepG2.NTCP cells enable a true infection model of HBV as the HBV infection is sustained due to the generation and presence of native cccDNA.

Figure 33:
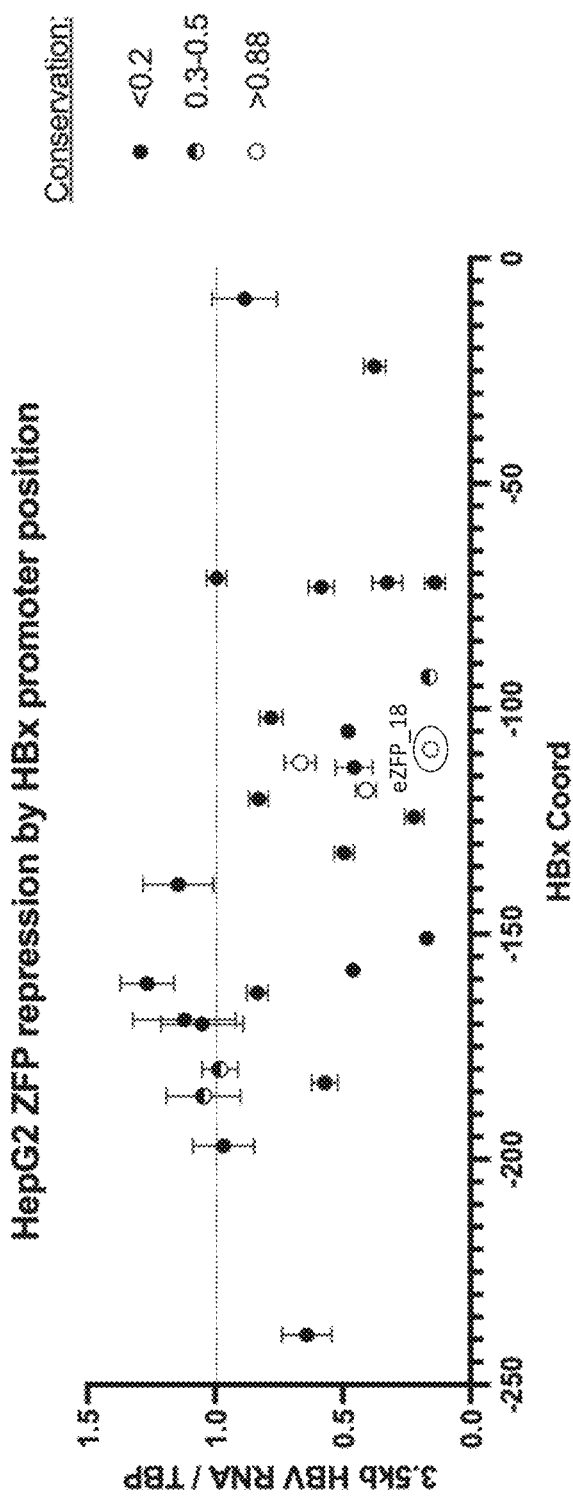
FIG. 33 shows the fold change in total HBV RNA mediated by each eZFP-KRAB fusion protein along with the conservation of the fusion protein across HBV subtypes.

The mRNA encoding the top 28 fusion proteins was generated and transfected via lipofectamine into the HepG2.NTCP cells in two batches. The cells expressing the eZFP-KRAB fusion proteins were assessed by qPCR for HBV RNA levels 6 days post-lipofection. FIGS. 32A-32B depict the fold change in total HBV RNA mediated by each eZFP-KRAB fusion protein in HepG2.NTCP cells. As shown in FIGS. 32A-32B, several eZFP-KRAB fusion proteins effectively repressed the HBV pregenomic (pgRNA) from the cccDNA by day six. FIG. 33 shows the fold change in total HBV RNA mediated by each eZFP-KRAB fusion protein across the HBx promoter position. The eZFP fusion proteins are color-coded by the percent of conservation across HBV subtypes. As shown in FIG. 33, several eZFP-KRAB fusion proteins targeted a range of sites across the HBx promoter region of the cccDNA and mediated transcriptional repression. Specifically, one of the best eZFP-KRAB repressor proteins (eZFP_18) showed about 91% conservation across the HBV subtypes.

Together, these results demonstrate robust repression of HBV expression by the eZFP-KRAB repressor proteins.

Figure 34:
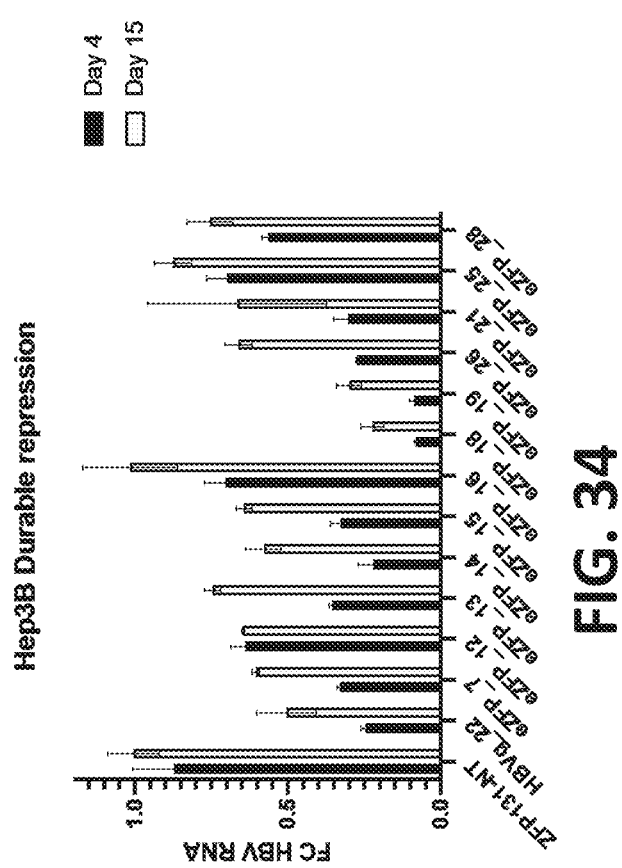
FIG. 34 shows the fold change in total HBV RNA mediated by each DNMT3A/L-eZFP-KRAB fusion protein on day 4 and day 15 post-transfection.

Example 11: Durable HBV Repression Achieved with DNMT3A/L-eZFP-KRAB Fusion Proteins Fusion proteins comprising DNMT3A/L (SEQ ID NO: 651), KRAB (SEQ ID NO:590), and one of the 12 most efficient eZFPs were designed to identify the DNMT3A/L-eZFP-KRAB fusion proteins with the highest transcriptional repression. The mRNA encoding the fusion proteins was generated and transfected via lipofectamine into Hep3B cells. The cells expressing the DNMT3A/L-eZFP-KRAB fusion proteins (Table E6) containing the eZFP linked to DNMT3A/L (SEQ ID NO:651) and KRAB (SEQ ID NO: 590) were assessed by qPCR for HBV RNA levels after day 4 or day 15. FIG. 34 shows the fold change in total HBV RNA mediated by each DNMT3A/L-eZFP-KRAB fusion protein. As shown in FIG. 34, several of the fusion proteins mediated transcriptional repression on day 4 and day 15. Specifically, the DNMT3A/L-eZFP-KRAB fusion proteins comprising eZFP_18 (SEQ ID NO:1017) and eZFP_19 (SEQ ID NO:1018) mediated the highest transcriptional repression by day 4, which was durable until day 15. The repression levels mediated by these fusion proteins was comparable to the levels mediated by DNMT3A/L-dSpCas9-KRAB (SEQ ID NO: 645) in combination with HBVg_22 (SEQ ID NO: 412).

Figure 35:
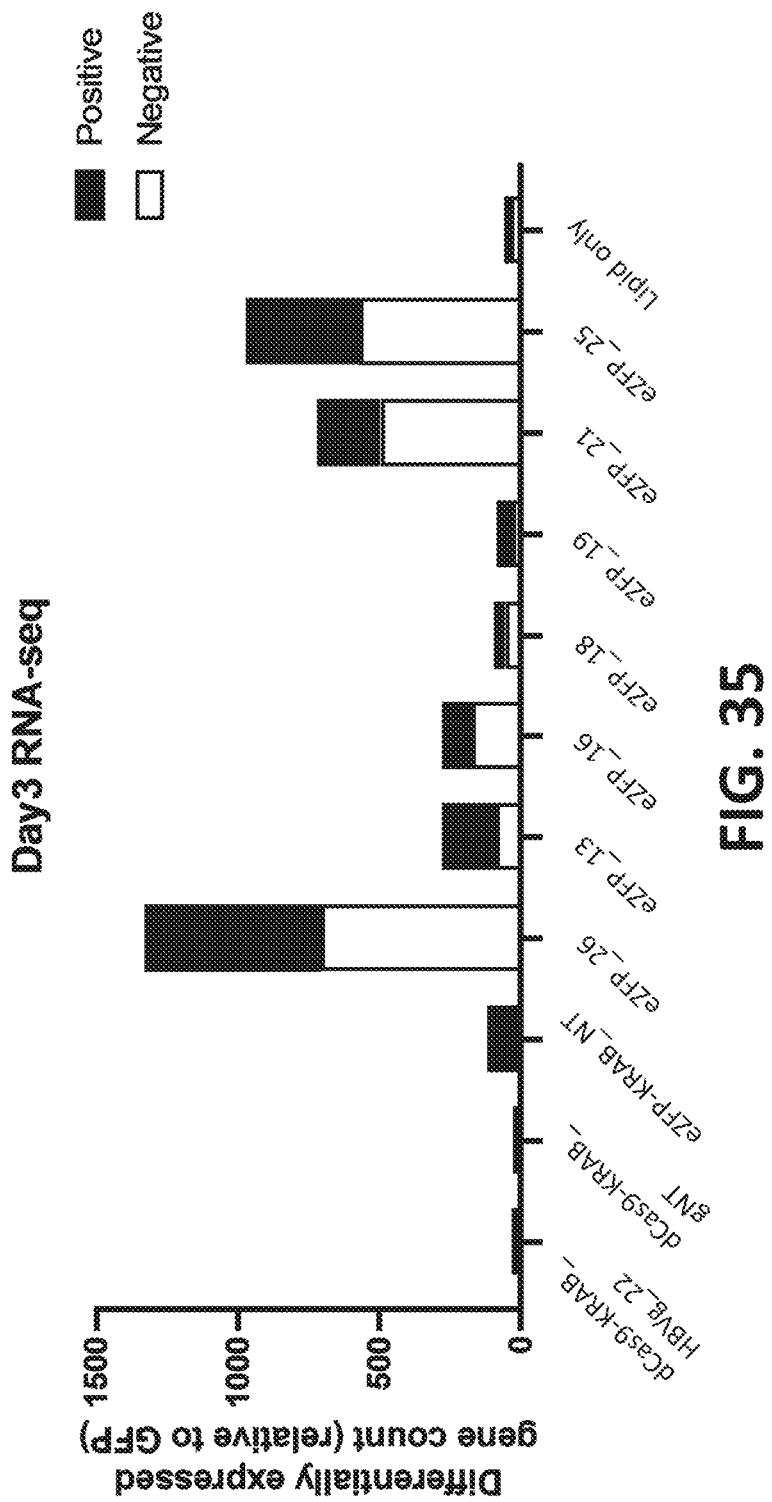
FIG. 35 shows minimal changes in differentially expressed genes mediated by eZFP-KRAB fusion protein compared to lipid only control.
Figure 36B:
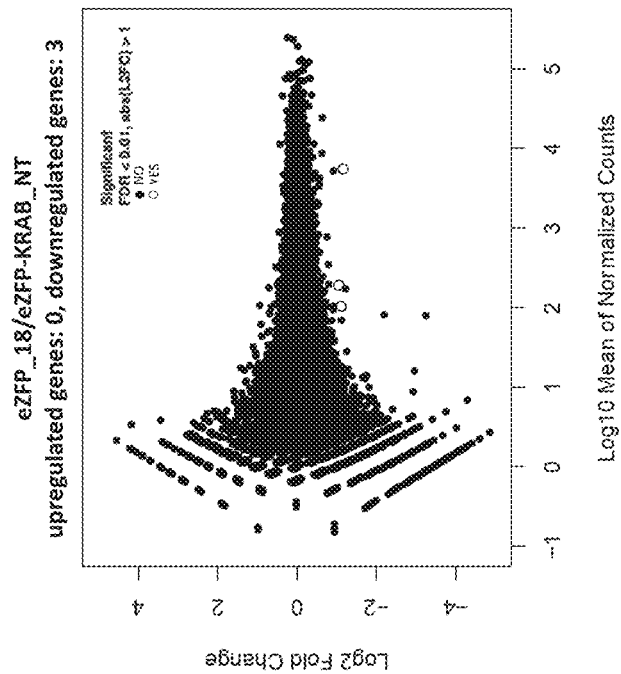
FIG. 36A-FIG. 36B reveal RNA sequencing analysis of eZFP-KRAB fusion protein-dependent changes on gene expression compared to either GFP (FIG. 36A) or a non-targeting (NT) control (FIG. 36B).
Figure 36A:
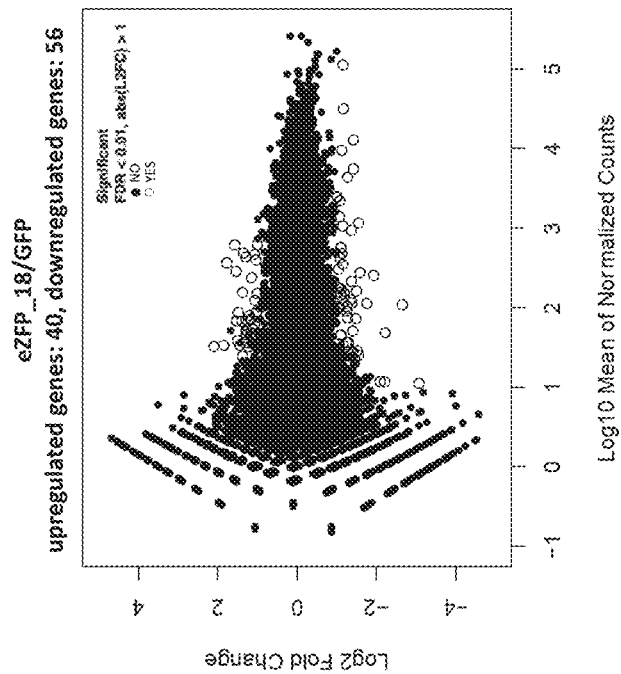

To assess differentially-expressed genes (DEG) mediated by the DNMT3A/L-eZFP-KRAB fusion proteins, HepG2.NTCP cells were transfected with the mRNA encoding the DNMT3A/L-eZFP-KRAB fusion proteins. The RNA was harvested after 72 hours and RNA-sequencing was performed. FIG. 35 shows changes in differentially expressed genes mediated by the fusion proteins 72 hours post-lipofection. The results show that DNMT3A/L-eZFP-KRAB fusion proteins composed of eZFP_18 (SEQ ID NO:1017) and eZFP_19 (SEQ ID NO:1018) induced minimal off-target differential expression relative to lipid control. Additionally, no significantly altered gene expression was seen following delivery of HBVg_22 (SEQ ID NO: 412) with dSpCas9-KRAB (SEQ ID NO: 594). FIGS. 36A-36B shows changes in differentially-expressed genes mediated by the DNMT3A/L-eZFP-KRAB fusion proteins 72 hours post-lipofection as compared to either GFP (FIG. 36A) or non-targeting (NT) control (FIG. 36B). The DNMT3A/L-eZFP-KRAB fusion proteins composed of eZFP_18 (SEQ ID NO:1017) imparted minimal to no off-target differential expression compared to either GFP only or a non-targeting ZFP-KRAB_NT fusion control.

Together, these results show durable transcriptional repression of HBV RNA by the DNMT3A/L-eZFP-KRAB repressor fusion proteins composed of eZFP_18 (SEQ ID NO: 1017) and eZFP_19 (SEQ ID NO:1018) mediated the highest transcriptional repression with minimal to no off-target gene expression. In general, these data support the therapeutic utility of the eZFPs, including in fusion proteins for targeted repression of HBV expression.

TABLE E6

DNMT3A/L-eZFP-KRAB fusion proteins

| SEQ ID NOs | Sequence | Description |
|---|---|---|
| 972 | ATGCACGATCAGGAGTTTGACCCCCCTAAGGTGTACCCACCCGTGCCAGCC GAGAAGAGGAAGCCCATCCGCGTGCTGTCCCTGTTCGACGGCATCGCCAC AGGCCTGCTGGTGCTGAAGGATCTGGGCATCCAGGTGGACAGATATATCG CCTCCGAGGTGTGCGAGGATTCTATCACCGTGGGCATGGTGAGGCACCAG GGCAAGATCATGTACGTGGGCGACGTGCGCAGCGTGACACAGAAGCACAT CCAGGAGTGGGGACCCTTCGACCTGGTCATCGGAGGCAGCCCCTGTAATG ACCTGTCCATCGTGAACCCTGCAAGGAAGGGCCTGTATGAGGGAACCGGC AGACTGTTCTTTGAGTTCTACAGGCTGCTGCACGACGCCCGCCCTAAGGAG GGCGATGACAGGCCATTCTTTTGGCTGTTTGAGAACGTGGTGGCCATGGGC GTGAGCGACAAGCGGGATATCTCCAGATTCCTGGAGTCTAATCCCGTGATG ATCGATGCAAAGGAGGTGTCTGCCGCACACAGGGCAAGGTACTTTTGGGG AAATCTGCCTGGCATGAACCGCCCACTGGCCAGCACCGTGAACGACAAGC TGGAGCTGCAGGAGTGCCTGGAGCACGGAAGGATCGCCAAGTTCTCCAAG GTGCGGACAATCACCACAAGATCTAACAGCATCAAGCAGGGCAAGGATCA GCACTTCCCCGTGTTCATGAATGAGAAGGAGGACATCCTGTGGTGTACCGA GATGGAGCGCGTGTTCGGCTTTCCAGTGCACTATACAGACGTGAGCAATAT GAGCCGGCTGGCAAGGCAGAGACTGCTGGGCCGGTCCTGGTCTGTGCCAG TGATCAGACACCTGTTCGCCCCCCTGAAGGAGTACTTTGCCTGCGTGTCTA GCGGCAACTCTAATGCCAACAGCAGAGGCCCTTCCTTTTCCTCTGGCCTGG TGCCACTGTCTCTGAGGGGCAGCCACATGGGCCCCATGGAGATCTACAAG ACCGTGTCCGCCTGGAAGAGGCAGCCTGTGCGCGTGCTGTCTCTGTTCCGC AACATCGACAAGGTGCTGAAGAGCCTGGGCTTTCTGGAGAGCGGATCCGG ATCTGGAGGAGGCACCCTGAAGTATGTGGAGGATGTGACAAATGTGGTGC GGAGAGATGTGGAGAAGTGGGGCCCCTTCGATCTGGTGTACGGATCCACC CAGCCACTGGGAAGCTCCTGCGATAGGTGTCCAGGATGGTATATGTTCCAG TTTCACAGAATCCTGCAGTACGCACTGCCAAGGCAGGAGAGCCAGCGCCC | 3xFLAG-DNMT3AL-XTEN80-SV40 NLS-ZFP-SV40 NLS-KRAB (DNA sequence) |

TABLE E6-continued

DNMT3A/L-eZFP-KRAB fusion proteins

| SEQ ID NOs | Sequence | Description |
|---|---|---|
|  | TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA<br>GGGGACGCGACTATCAGAATGCCATGCGGGTGTGGTCTAACATCCCTGGC<br>CTGAAGAGCAAGCACGCCCCCTGACCCCTAAGGAGGAGGAGTACCTGCA<br>GGCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC<br>AGAATAGCCTGCCACTGGGTGGACCTAGCTCTGGAGCCCCGCCTCCGTCAG<br>GTGGATCTCCTGCAGGTAGCCCAACTTCCACGGAAGAGGGCACGTCTGAG<br>AGTGCGACTCCTGAGAGCGGGCCTGGCACAAGTACTGAGCCCAGCGAAGG<br>TTCTGCACCCGGGTCTCCAGCTGGGAGCCCTACCTCAACAGAGGAAGGTAC<br>CAGCACAGAGCCTTCTGAGGGTAGCGCTCCTGGCACGTCCACCGAACCGTC<br>CGAGGGGATGGCACCGAAGAAAAAACGCAAAGTTGGTCGAGCTGCTATGG<br>CAGAGCGGCCATTTCAGTGTCGAATTTGCATGCGAAATTTCTCTAGCGAAG<br>CGGATCGAAGTAGACATATCCGGACCCATACGGGTGAGAAACCGTTCGCG<br>TGTGATATATGCGGTCGCAAATTCGCAGACCGCTCCAACCTGACAAGGCAC<br>ACAAAAATTCATACTGGAAGCCAGAAACCGTTTCAGTGCCGGATTTGTATG<br>CGCAATTTCTCTCAATCCTCCGATCTCTCCCGCCACATCAGGACTCATACCG<br>GGGAGAAACCCTTTGCTTGTGACATTTGTGGCAGAAAGTTTGCCTATCACT<br>GGTACCTTAAGAAGCACACCAAGATCCATACTGGCTCTCAAAAGCCTTTCC<br>AATGCCGAATATGTATGCGAAACTTTTCTAGGTCTGACTCCCTCTCTGTAC<br>ATATCCGCACTCACACGGGTGAAAAACCATTTGCCTGTGACATATGTGGCA<br>GAAAATTTGCTCAAAATGCGAACCGAAAAACGCATACGAAATCCATTTG<br>CGACAAAAAGATGCAGCTCGGGCTCCGGACCGAAAAAAAAAGAGAAAGGT<br>AAACGGCGGGGAGGATCACGGACCCTGGTTACATTTAAGGACGTTTTTGT<br>AGACTTCACGAGGGAGGAATGGAAGCTGTTGGACACCGCCCAGCAAATCG<br>TGTATCGAAATGTAATGTTGGAAAATTATAAAAATCTGGTTTCCCTCGGCT<br>ACCAATTGACAAAACCAGACGTCATCCTCAGACTGGAAAAAGGGGAAGAA<br>CCTTGGCTTGTCTGA |  |
| 973 | ATGCACGATCAGGAGTTTGACCCCCCTAAGGTGTACCCACCCGTGCCAGCC<br>GAGAAGAGGAAGCCCATCCGCGTGCTGCTGTCCCTGTTCGACGGCATCGCCAC<br>AGGCCTGCTGGTGCTGAAGGATCTGGGCATCCAGGTGGACAGATATATCG<br>CCTCCGAGGTGTGCGAGGATTCTATCACCGTGGGCATGGTGAGGCACCAG<br>GGCAAGATCATGTACGTGGGCGACGTGCGCAGCGTGACACAGAAGCACAT<br>CCAGGAGTGGGGACCCTTCGACCTGGTCATCGGAGGCAGCCCCTGTAATG<br>ACCTGTCCATCGTGAACCCTGCAAGGAAGGGCCTGTATGAGGGAACCGGC<br>AGACTGTTCTTTGAGTTCTACAGGCTGCTGCACGACGCCCGCCCTAAGGAG<br>GGCGATGACAGGCCATTCTTTTGGCTGTTTGAGAACGTGGTGGCCATGGGC<br>GTGAGCGACAAGCGGGATATCTCCAGATTCCTGGAGTCTAATCCCGTGATG<br>ATCGATGCAAAGGAGGTGTCTGCCGCACACAGGGCAAGGTACTTTTGGGG<br>AAATCTGCCTGGCATGAACCGCCCACTGGCCAGCACCGTGAACGACAAGC<br>TGGAGCTGCAGGAGTGCCTGGAGCACGGAAGGATCGCCAAGTTCTCCAAG<br>GTGCGGACAATCACCACAAGATCTAACAGCATCAAGCAGGGCAAGGATCA<br>GCACTTCCCCGTGTTCATGAATGAGAAGGAGGACATCCTGTGGTGTACCGA<br>GATGGAGCGCGTGTTCGGCTTTCCAGTGCACTATACAGACGTGAGCAATAT<br>GAGCCGGCTGGCAAGGCAGAGACTGCTGGGCCGGTCCTGGTCTGTGCCAG<br>TGATCAGACACCTGTTCGCCCCCCTGAAGGAGTACTTTGCCTGCGTGTCTA<br>GCGGCAACTCTAATGCCAACAGCAGAGGCCCTTCCTTTTCCTCTGGCCTGG<br>TGCCACTGTCTCTGAGGGGCAGCCACATGGGCCCCATGGAGATCTACAAG<br>ACCGTGTCCGCCTGGAAGAGGCAGCCTGTGCGCGTGCTGTCTCTGTTCCGC<br>AACATCGACAAGGTGCTGAAGAGCCTGGGCTTTCTGGAGAGCGGATCCGG<br>ATCTGGAGGAGGCACCCTGAAGTATGTGGAGGATGTGACAAATGTGGTGC<br>GGAGAGATGTGGAGAAGTGGGGCCCCTTCGATCTGGTGTACGGATCCACC<br>CAGCCACTGGGAAGCTCCTGCGATAGGTGTCCAGGATGGTATATGTTCCAG<br>TTTCACAGAATCCTGCAGTACGCACTGCCAAGGCAGGAGAGCCAGCGCCC<br>TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA<br>GGGGACGCGACTATCAGAATGCCATGCGGGTGTGGTCTAACATCCCTGGC<br>CTGAAGAGCAAGCACGCCCCCTGACCCCTAAGGAGGAGGAGTACCTGCA<br>GGCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC<br>AGAATAGCCTGCCACTGGGTGGACCTAGCTCTGGAGCCCCGCCTCCGTCAG<br>GTGGATCTCCTGCAGGTAGCCCAACTTCCACGGAAGAGGGCACGTCTGAG<br>AGTGCGACTCCTGAGAGCGGGCCTGGCACAAGTACTGAGCCCAGCGAAGG<br>TTCTGCACCCGGGTCTCCAGCTGGGAGCCCTACCTCAACAGAGGAAGGTAC<br>CAGCACAGAGCCTTCTGAGGGTAGCGCTCCTGGCACGTCCACCGAACCGTC<br>CGAGGGGATGGCACCGAAGAAAAACGCAAAGTTGGTCGAGCGGCAATG<br>GCAGAACGCCCGTTTCAGTGTAGAATCTGCATGCGCAATTTCTCCAGAAGT<br>GACGTACTCAGCACGCATATCAGAACACATACTGGTGAAAAACCGTTTGCT<br>TGTGATATCTGTGGTAAGAAATTCGCGGATAACTCCTCAAGGACGCGGCAT<br>ACGAAGATCCACACTGGTTCTCAAAAGCCGTTCCAGTGCCGGATATGCATG<br>CGGAACTTTAGTCGGCCATATACGCTTCGACTTCATATTAGGACTCACACC<br>GGCGAAAAGCCGTTCGCCTGTGACATTTGCGGGAGAAAATTCGCTGACTCT<br>AGTCACCGCACGAGGCACACTAAAATACATACTGGTTCACAAAAACCATT | 3xFLAG-<br>DNMT3AL-<br>XTEN80-SV40<br>NLS-ZFP-SV40<br>NLS-KRAB<br>(DNA sequence) |

TABLE E6-continued

DNMT3A/L-eZFP-KRAB fusion proteins

| SEQ ID NOs | Sequence | Description |
|---|---|---|
| | CCAGTGCCGAATTTGCATGCGAAATTTTTCCCGAAGTGACCATCTCTCACA<br>GCACATCCGCACCCATACAGGGGAGAAGCCCTTCGCTTGTGTATATATGCGG<br>ACGCAAGTTCGCGGACAGCTCACACCGGACCCGCCATACAAAGATCCACT<br>TGAGACAGAAAGATGCAGCGCGGGCTCCGGACCGAAAAAAAAGAGAAAG<br>GTAAACGGCGGGGGAGGATCACGGACCCTGGTTACATTTAAGGACGTTTTT<br>GTAGACTTCACGAGGGAGGAATGGAAGCTGTTGGACACCGCCCAGCAAAT<br>CGTGTATCGAAATGTAATGTTGGAAAATTATAAAAATCTGGTTTCCCTCGG<br>CTACCAATTGACAAAACCAGACGTCATCCTCAGACTGGAAAAAGGGGAAG<br>AACCTTGGCTTGTCTGA | |
| 974 | ATGCACGATCAGGAGTTTGACCCCCCTAAGGTGTACCCACCCGTGCCAGCC<br>GAGAAGAGGAAGCCCATCCGCGTGCTGTCCCTGTTCGACGGCATCGCCAC<br>AGGCCTGCTGGTGCTGAAGGATCTGGGCATCCAGGTGGACAGATATATCG<br>CCTCCGAGGTGTGCGAGGATTCTATCACCGTGGGCATGGTGAGGCACCAG<br>GGCAAGATCATGTACGTGGGCGACGTGCGCAGCGTGACACAGAAGCACAT<br>CCAGGAGTGGGGACCCTTCGACCTGGTCATCGGAGGCAGCCCCTGTAATG<br>ACCTGTCCATCGTGAACCCTGCAAGGAAGGGCCTGTATGAGGGAACCGGC<br>AGACTGTTCTTTGAGTTCTACAGGCTGCTGCACGACGCCCGCCCTAAGGAG<br>GGCGATGACAGGCCATTCTTTTGGCTGTTTGAGAACGTGGTGGCCATGGGC<br>GTGAGCGACAAGCGGGATATCTCCAGATTCCTGGAGTCTAATCCCGTGATG<br>ATCGATGCAAAGGAGGTGTCTGCCGCACACAGGGCAAGGTACTTTTGGGG<br>AAATCTGCCTGGCATGAACCGCCCACTGGCCAGCACCGTGAACGACAAGC<br>TGGAGCTGCAGGAGTGCCTGGAGCACGGAAGGATCGCCAAGTTCTCCAAG<br>GTGCGGACAATCACCACAAGATCTAACAGCATCAAGCAGGGCAAGGATCA<br>GCACTTCCCCGTGTTCATGAATGAGAAGGAGGACATCCTGTGGTGTACCGA<br>GATGGAGCGCGTGTTCGGCTTTCCAGTGCACTATACAGACGTGAGCAATAT<br>GAGCCGGCTGGCAAGGCAGAGACTGCTGGGCCGGTCCTGGTCTGTGCCAG<br>TGATCAGACACCTGTTCGCCCCCCTGAAGGAGTACTTTGCCTGCGTGTCTA<br>GCGGCAACTCTAATGCCAACAGCAGAGGCCCTTCCTTTTCCTCTGGCCTGG<br>TGCCACTGTCTCTGAGGGGCAGCCACATGGGCCCCATGGAGATCTACAAG<br>ACCGTGTCCGCCTGGAAGAGGCAGCCTGTGCGCGTGCTGTCTCTGTTCCGC<br>AACATCGACAAGGTGCTGAAGAGCCTGGGCTTTCTGGAGAGCGGATCCGG<br>ATCTGGAGGAGGCACCCTGAAGTATGTGGAGGATGTGACAAATGTGGTGC<br>GGAGAGATGTGGAGAAGTGGGGCCCCTTCGATCTGGTGTACGGATCCACC<br>CAGCCACTGGGAAGCTCCTGCGATAGGTGTCCAGGATGGTATATGTTCCAG<br>TTTCACAGAATCCTGCAGTACGCACTGCCAAGGCAGGAGAGCCAGCGCCC<br>TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA<br>GGGGACGCGACTATCAGAATGCCATGCGGGTGTGGTCTAACATCCCTGGC<br>CTGAAGAGCAAGCACGCCCCCCTGACCCCTAAGGAGGAGGTACCTGCA<br>GGCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC<br>AGAATAGCCTGCCACTGGGTGGACCTAGCTCTGGAGCCCCGCCTCCGTCAG<br>GTGGATCTCCTGCAGGTAGCCCAACTTCACGGAAGAGGGCACGTCTGAG<br>AGTGCGACTCCTGAGAGCGGGCCTGGCACAAGTACTGAGCCCAGCGAAGG<br>TTCTGCACCCGGGTCTCCAGCTGGGAGCCCTACCTCAACAGAGGAAGGTAC<br>CAGCACAGAGCCTTCTGAGGGTAGCGCTCCTGGCACGTCCACCGAACCGTC<br>CGAGGGGATGGCACCGAAGAAAAAACGCAAAGTTGGTCGAGCCGCAATG<br>GCCGAAAGACCATTTCAGTCAGGATATGTATGCGCAACTTCTCTCGCAGT<br>GACCACCTGAGTCAACATATCAGGACACACACGGGTGAAAAGCCTTTTGC<br>ATGCGATATTTGTGGTCGAAAATTTGCTCAGTCTGCGGACCGAACCAAGCA<br>CACTAAAATTCATACCGGCTCACAGAAACCGTTTCAATGCCGCATCTGTAT<br>GAGGAATTTCTCTAGATCAGACCACTTGTCCCAACACATCCGGACTCATAC<br>TGGAGAAAAGCCGTTTGCATGTGACATTTGTGGCAGGAAGTTTGCTAGAA<br>GGTCTGACCTTAAAAGGCACACAAAAATTCATACGGGTTCCCAGAAACCA<br>TTTCAGTGCCGGATATGCATGCGGAACTTTTCACGAAGCGACCACCTCTCC<br>CGACATATTCGAACGCACACTGGTGAGAAGCCGTTTGCTTGCGACATTTGC<br>GGACGCAAGTTCGCTCAGAGCTCCGACTTGAGGAGGCATACCAAGATTCA<br>TCTCCGGCAGAAAGATGCCGCGCGGGCTCCGGACCGAAAAAAAGAGAA<br>AGGTAAACGGCGGGGAGGATCACGGACCCTGGTTACATTTAAGGACGTT<br>TTTGTAGACTTCACGAGGGAGGAATGGAAGCTGTTGGACACCGCCCAGCA<br>AATCGTGTATCGAAATGTAATGTTGGAAAATTATAAAAATCTGGTTTCCCT<br>CGGCTACCAATTGACAAAACCAGACGTCATCCTCAGACTGGAAAAAGGGG<br>AAGAACCTTGGCTTGTCTGA | 3xFLAG-<br>DNMT3AL-<br>XTEN80-SV40<br>NLS-ZFP-SV40<br>NLS-KRAB<br>(DNA sequence) |
| 975 | ATGCACGATCAGGAGTTTGACCCCCCTAAGGTGTACCCACCCGTGCCAGCC<br>GAGAAGAGGAAGCCCATCCGCGTGCTGTCCCTGTTCGACGGCATCGCCAC<br>AGGCCTGCTGGTGCTGAAGGATCTGGGCATCCAGGTGGACAGATATATCG<br>CCTCCGAGGTGTGCGAGGATTCTATCACCGTGGGCATGGTGAGGCACCAG<br>GGCAAGATCATGTACGTGGGCGACGTGCGCAGCGTGACACAGAAGCACAT<br>CCAGGAGTGGGGACCCTTCGACCTGGTCATCGGAGGCAGCCCCTGTAATG<br>ACCTGTCCATCGTGAACCCTGCAAGGAAGGGCCTGTATGAGGGAACCGGC<br>AGACTGTTCTTTGAGTTCTACAGGCTGCTGCACGACGCCCGCCCTAAGGAG<br>GGCGATGACAGGCCATTCTTTTGGCTGTTTGAGAACGTGGTGGCCATGGGC | 3xFLAG-<br>DNMT3AL-<br>XTEN80-SV40<br>NLS-ZFP-SV40<br>NLS-KRAB<br>(DNA sequence) |

TABLE E6-continued

DNMT3A/L-eZFP-KRAB fusion proteins

| SEQ ID NOs | Sequence | Description |
|---|---|---|
| | GTGAGCGACAAGCGGGATATCTCCAGATTCCTGGAGTCTAATCCCGTGATG<br>ATCGATGCAAAGGAGGTGTCTGCCGCACACAGGGCAAGGTACTTTTGGGG<br>AAATCTGCCTGGCATGAACCGCCCACTGGCCAGCACCGTGAACGACAAGC<br>TGGAGCTGCAGGAGTGCCTGGAGCACGGAAGGATCGCCAAGTTCTCCAAG<br>GTGCGGACAATCACCACAAGATCTAACAGCATCAAGCAGGGCAAGGATCA<br>GCACTTCCCCGTGTTCATGAATGAGAAGGAGGACATCCTGTGGTGTACCGA<br>GATGGAGCGCGTGTTCGGCTTTCCAGTGCACTATACAGACGTGAGCAATAT<br>GAGCCGGCTGGCAAGGCAGAGACTGCTGGGCCGGTCCTGGTCTGTGCCAG<br>TGATCAGACACCTGTTCGCCCCCCTGAAGGAGTACTTTGCCTGCGTGTCTA<br>GCGGCAACTCTAATGCCAACAGCAGAGGCCCTTCCTTTTCCTCTGGCCTGG<br>TGCCACTGTCTCTGAGGGGCAGCCACATGGGCCCCATGGAGATCTACAAG<br>ACCGTGTCCGCCTGGAAGAGGCAGCCTGTGCGCGTGCTGTCTCTGTTCCGC<br>AACATCGACAAGGTGCTGAAGAGCCTGGCTTTCTGGAGAGCGGATCCGG<br>ATCTGGAGGAGGCACCCTGAAGTATGTGGAGGATGTGACAAATGTGGTGC<br>GGAGAGATGTGGAGAAGTGGGGCCCCTTCGATCTGGTGTACGGATCCACC<br>CAGCCACTGGGAAGCTCCTGCGATAGGTGTCCAGGATGGTATATGTTCCAG<br>TTTCACAGAATCCTGCAGTACGCACTGCCAAGGCAGGAGAGCCAGCGCCC<br>TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA<br>GGGGACGCGACTATCAGAATGCCATGCGGGTGTGGTCTAACATCCCTGGC<br>CTGAAGAGCAAGCACGCCCCCTGACCCCTAAGGAGGAGGAGTACCTGCA<br>GGCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC<br>AGAATAGCCTGCCACTGGGTGGACCTAGCTCTGGAGCCCCGCCTCCGTCAG<br>GTGGATCTCCTGCAGGTAGCCCAACTTCCACGGAAGAGGGCACGTCTGAG<br>AGTGCGACTCCTGAGAGCGGGCCTGGCACAAGTACTGAGCCCAGCGAAGG<br>TTCTGCACCCGGGTCTCCAGCTGGGAGCCCTACCTCAACAGAGGAAGGTAC<br>CAGCACAGAGCCTTCTGAGGGTAGCGCTCCTGGCACGTCCACCGAACCGTC<br>CGAGGGGATGGCACCGAAGAAAAAACGCAAAGTTGGTCGAGCCGCGATG<br>GCTGAGAGACCATTTCAGTGTCGAATCTGCATGAGAAATTTTCAAGGAGT<br>GACAATCTGTCTGAGCACATACGAACACATACTGGGGAAAAACCCTTTGC<br>ATGTGACATTTGTGGAAGAAAGTTTGCTACCAGCTCAAATCGCAAAACAC<br>ATACAAAGATACATACCGGCTCCCAAAAGCCATTCCAGTGCCGCATCTGCA<br>TGAGGAACTTTTCCGATCGCTCACATCTTACCCGCCACATAAGAACTCACA<br>CAGGCGAAAAGCCCTTTGCCTGCGATATATGCGGACGGAAGTTCGCCCGCT<br>CCGACGCTTTGACCCAGCATACCAAAATCCATACTGGGTCTCAAAAGCCAT<br>TTCAGTGCCGAATCTGTATGAGGAATTTCTCCGACAGGTCAGCATTGGCAC<br>GGCATATCCGCACCCATACCGGTGAGAAGCCTTTTGCTTGCGATATCTGTG<br>GACGAAAATTTGCCCGGAGGTTCACTCTCTCCAAACACACAAAGATACATC<br>TGCGCCAAAAGGATGCAGCCCGGGCTCCGGACCGAAAAAAAGAGAAAG<br>GTAAACGGCGGGGAGGATCACGGACCCTGGTTACATTTAAGGACGTTTTT<br>GTAGACTTCACGAGGGAGGAATGGAAGCTGTTGGACACCGCCCAGCAAAT<br>CGTGTATCGAAATGTAATGTTGGAAAATTATAAAAATCTGGTTTCCCTCGG<br>CTACCAATTGACAAAACCAGACGTCATCCTCAGACTGGAAAAAGGGGAAG<br>AACCTTGGCTTGTCTGA | |
| 976 | ATGCACGATCAGGAGTTTGACCCCCCTAAGGTGTACCCACCCGTGCCAGCC<br>GAGAAGAGGAAGCCCATCCGCGTGCTGTCCCTGTTCGACGGCATCGCCAC<br>AGGCCTGCTGGTGCTGAAGGATCTGGGCATCCAGGTGGACAGATATATCG<br>CCTCCGAGGTGTGCGAGGATTCTATCACCGTGGGCATGGTGAGGCACCAG<br>GGCAAGATCATGTACGTGGGCGACGTGCGCAGCGTGACACAGAAGCACAT<br>CCAGGAGTGGGGACCCTTCGACCTGGTCATCGGAGGCAGCCCCTGTAATG<br>ACCTGTCCATCGTGAACCCTGCAAGGAAGGGCCTGTATGAGGGAACCGGC<br>AGACTGTTCTTTGAGTTCTACAGGCTGCTGCACGACGCCCGCCCTAAGGAG<br>GGCGATGACAGGCCATTCTTTTGGCTGTTTGAGAACGTGGTGGCCATGGGC<br>GTGAGCGACAAGCGGGATATCTCCAGATTCCTGGAGTCTAATCCCGTGATG<br>ATCGATGCAAAGGAGGTGTCTGCCGCACACAGGGCAAGGTACTTTTGGGG<br>AAATCTGCCTGGCATGAACCGCCCACTGGCCAGCACCGTGAACGACAAGC<br>TGGAGCTGCAGGAGTGCCTGGAGCACGGAAGGATCGCCAAGTTCTCCAAG<br>GTGCGGACAATCACCACAAGATCTAACAGCATCAAGCAGGGCAAGGATCA<br>GCACTTCCCCGTGTTCATGAATGAGAAGGAGGACATCCTGTGGTGTACCGA<br>GATGGAGCGCGTGTTCGGCTTTCCAGTGCACTATACAGACGTGAGCAATAT<br>GAGCCGGCTGGCAAGGCAGAGACTGCTGGGCCGGTCCTGGTCTGTGCCAG<br>TGATCAGACACCTGTTCGCCCCCCTGAAGGAGTACTTTGCCTGCGTGTCTA<br>GCGGCAACTCTAATGCCAACAGCAGAGGCCCTTCCTTTTCCTCTGGCCTGG<br>TGCCACTGTCTCTGAGGGGCAGCCACATGGGCCCCATGGAGATCTACAAG<br>ACCGTGTCCGCCTGGAAGAGGCAGCCTGTGCGCGTGCTGTCTCTGTTCCGC<br>AACATCGACAAGGTGCTGAAGAGCCTGGCTTTCTGGAGAGCGGATCCGG<br>ATCTGGAGGAGGCACCCTGAAGTATGTGGAGGATGTGACAAATGTGGTGC<br>GGAGAGATGTGGAGAAGTGGGGCCCCTTCGATCTGGTGTACGGATCCACC<br>CAGCCACTGGGAAGCTCCTGCGATAGGTGTCCAGGATGGTATATGTTCCAG<br>TTTCACAGAATCCTGCAGTACGCACTGCCAAGGCAGGAGAGCCAGCGCCC<br>TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA | 3xFLAG-<br>DNMT3AL-<br>XTEN80-SV40<br>NLS-ZFP-SV40<br>NLS-KRAB<br>(DNA sequence) |

TABLE E6-continued

DNMT3A/L-eZFP-KRAB fusion proteins

| SEQ ID NOs | Sequence | Description |
|---|---|---|
|  | GGGGACGCGACTATCAGAATGCCATGCGGGTGTGGTCTAACATCCCTGGC<br>CTGAAGAGCAAGCACGCCCCCCTGACCCCTAAGGAGGAGGAGTACCTGCA<br>GGCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC<br>AGAATAGCCTGCCACTGGGTGGACCTAGCTCTGGAGCCCCGCCTCCGTCAG<br>GTGGATCTCCTGCAGGTAGCCCAACTTCCACGGAAGAGGGCACGTCTGAG<br>AGTGCGACTCCTGAGAGCGGGCCTGGCACAAGTACTGAGCCCAGCGAAGG<br>TTCTGCACCCGGGTCTCCAGCTGGGAGCCCTACCTCAACAGAGGAAGGTAC<br>CAGCACAGAGCCTTCTGAGGGTAGCGCTCCTGGCACGTCCACCGAACCGTC<br>CGAGGGGATGGCACCGAAGAAAAAACGCAAAGTTGGTCGAGCCGCAATG<br>GCTGAGCGCCCGTTCCAGTGCAGAATATGCATGCGGAATTTTTCTAGGTCA<br>GATCATTTGTCTGAGCATATTCGCACACACACGGGAGAGAAGCCCTTTGCT<br>TGCGATATATGTGGAAGGAAATTCGCGCAATACAGTGGGCGCTACTACCA<br>TACAAAGATCCATACGGGCTCCCAGAAGCCCTTCCAATGTCGAATATGTAT<br>GAGGAATTTTAGTCACGGACAAACATTGAATGAACATATACGCACTCACA<br>CTGGTGAAAAACCATTTGCGTGCGATATTTGCGGAAGGAAGTTTGCTCAGT<br>CTGGGAATTTGGCGCGACACACCAAGATCCACACAGGATCCCAGAAACCA<br>TTTCAGTGCAGAATTTGTATGAGAAACTTTAGCCGCAGTGACAGTCTCTTG<br>AGGCACATACGGACTCATACTGGGGAGAAACCATTCGCCTGCGATATTTGT<br>GGACGAAAGTTCGCCTGTCGCGAGTACAGAGGCAAGCACACTAAGATACA<br>TCTTAGGCAAAAGGACGCTGCACGGGCTCCGGACCGAAAAAAAAGAGAA<br>AGGTAAACGGCGGGGAGGATCACGGACCCTGGTTACATTTAAGGACGTT<br>TTTGTAGACTTCACGAGGGAGGAATGGAAGCTGTTGGACACCGCCCAGCA<br>AATCGTGTATCGAAATGTAATGTTGGAAAATTATAAAAATCTGGTTTCCCT<br>CGGCTACCAATTGACAAAACCAGACGTCATCCTCAGACTGGAAAAAGGGG<br>AAGAACCTTGGCTTGTCTGA |  |
| 977 | ATGCACGATCAGGAGTTTGACCCCCCTAAGGTGTACCCACCCGTGCCAGCC<br>GAGAAGAGGAAGCCCATCCGCGTGCTGTCCCTGTTCGACGGCATCGCCAC<br>AGGGCCTGCTGGTGCTGAAGGATCTGGGCATCCAGGTGGACAGATATATCG<br>CCTCCGAGGTGTGCGAGGATTCTATCACCGTGGGCATGGTGAGGCACCAG<br>GGCAAGATCATGTACGTGGGCGACGTGCGCAGCGTGACACAGAAGCACAT<br>CCAGGAGTGGGGACCCTTCGACCTGGTCATCGGAGGCAGCCCCTGTAATG<br>ACCTGTCCATCGTGAACCCTGCAAGGAAGGGCCTGTATGAGGGAACCGGC<br>AGACTGTTCTTTGAGTTCTACAGGCTGCTGCACGACGCCCGCCCTAAGGAG<br>GGCGATGACAGGCCATTCTTTTGGCTGTTTGAGAACGTGGTGGCCATGGGC<br>GTGAGCGACAAGCGGGATATCTCCAGATTCCTGGAGTCTAATCCCGTGATG<br>ATCGATGCAAAGGAGGTGTCTGCCGCACACAGGGCAAGGTACTTTTGGGG<br>AAATCTGCCTGGCATGAACCGCCCACTGGCCAGCACCGTGAACGACAAGC<br>TGGAGCTGCAGGAGTGCCTGGAGCACGGAAGGATCGCCAAGTTCTCCAAG<br>GTGCGGACAATCACCACAAGATCTAACAGCATCAAGCAGGGCAAGGATCA<br>GCACTTCCCCGTGTTCATGAATGAGAAGGAGGACATCCTGTGGTGTACCGA<br>GATGGAGCGCGTGTTCGGCTTTCCAGTGCACTATACAGACGTGAGCAATAT<br>GAGCCGGCTGGCAAGGCAGAGACTGCTGGGCCGGTCCTGGTCTGTGCCAG<br>TGATCAGACACCTGTTCGCCCCCCTGAAGGAGTACTTTGCCTGCGTGTCTA<br>GCGGCAACTCTAATGCCAACAGCAGAGGCCCTTCCTTTTCCTCTGGCCTGG<br>TGCCACTGTCTCTGAGGGGCAGCCACATGGGCCCCATGGAGATCTACAAG<br>ACCGTGTCCGCCTGGAAGAGGCAGCCTGTGCGCGTGCTGTCTCTGTTCCGC<br>AACATCGACAAGGTGCTGAAGAGCCTGGGCTTTCTGGAGAGCGGATCCGG<br>ATCTGGAGGAGGCACCCTGAAGTATGTGGAGGATGTGACAAATGTGGTGC<br>GGAGAGATGTGGAGAAGTGGGGCCCCTTCGATCTGGTGTACGGATCCACC<br>CAGCCACTGGGAAGCTCCTGCGATAGGTGTCCAGGATGGTATATGTTCAG<br>TTTCACAGAATCCTGCAGTACGCACTGCCAAGGCAGGAGAGCCAGCGCCC<br>TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA<br>GGGGACGCGACTATCAGAATGCCATGCGGGTGTGGTCTAACATCCCTGGC<br>CTGAAGAGCAAGCACGCCCCCCTGACCCCTAAGGAGGAGGAGTACCTGCA<br>GGCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC<br>AGAATAGCCTGCCACTGGGTGGACCTAGCTCTGGAGCCCCGCCTCCGTCAG<br>GTGGATCTCCTGCAGGTAGCCCAACTTCCACGGAAGAGGGCACGTCTGAG<br>AGTGCGACTCCTGAGAGCGGGCCTGGCACAAGTACTGAGCCCAGCGAAGG<br>TTCTGCACCCGGGTCTCCAGCTGGGAGCCCTACCTCAACAGAGGAAGGTAC<br>CAGCACAGAGCCTTCTGAGGGTAGCGCTCCTGGCACGTCCACCGAACCGTC<br>CGAGGGGATGGCACCGAAGAAAAAACGCAAAGTTGGTCGAGCCGCGATG<br>GCTGAGAGGCCTTTTCAATGTCGAATCTGTATGAGGAACTTCTCTCAATCT<br>GCTAATCGCACGACGCACATTCGAACGCATACCGGTGAGAAGCCATTCGC<br>GTGCGATATCTGCGGACGAAATTCGCGAGGTCAGCTAATCTTACACGGC<br>ACACGAAGATCCACACAGGGTCACAGAAACCTTTTCAGTGTCGCATTTGCA<br>TGAGGAATTTCTCCCGATCTGACGTCCTTAGCGAACATATACGAACTCACA<br>CGGGCGAGAAGCCATTTGCGTGCGATATATGCGGGAGGAAGTTTGCCACC<br>TCTGGACATCTGAGTCGACATACCAAAATTCATACCGGTAGTCAGAAGCCG<br>TTCCAATGCAGAATATGTATGCGAAATTTCTCTCAAAGCTCAGACTTGTCT<br>AGGCACATAAGAACGCACACGGGTGAAAAACCTTTCGCGTGTGATATCTG | 3xFLAG-<br>DNMT3AL-<br>XTEN80-SV40<br>NLS-ZFP-SV40<br>NLS-KRAB<br>(DNA sequence) |

TABLE E6-continued

DNMT3A/L-eZFP-KRAB fusion proteins

| SEQ ID NOs | Sequence | Description |
|---|---|---|
| | CGGCAGAAAGTTCGCACAATGGTCCACCCGAAAGCGGCATACGAAGATTC<br>ACCTCAGACAGAAAGACGCTGCCCGGGCTCCGGACCGAAAAAAAAGAGA<br>AAGGTAAACGGCGGGGGAGGATCACGGACCCTGGTTACATTTAAGGACGT<br>TTTTGTAGACTTCACGAGGGAGGAATGGAAGCTGTTGGACACCGCCCAGC<br>AAATCGTGTATCGAAATGTAATGTTGGAAAATTATAAAAATCTGGTTTCCC<br>TCGGCTACCAATTGACAAAACCAGACGTCATCCTCAGACTGGAAAAAGGG<br>GAAGAACCTTGGCTTGTCTGA | |
| 978 | ATGCACGATCAGGAGTTTGACCCCCCTAAGGTGTACCCACCCGTGCCAGCC<br>GAGAAGAGGAAGCCCATCCGCGTGCTGTCCCTGTTCGACGGCATCGCCAC<br>AGGCCTGCTGGTGCTGAAGGATCTGGGCATCCAGGTGGACAGATATATCG<br>CCTCCGAGGTGTGCGAGGATTCTATCACCGTGGGCATGGTGAGGCACCAG<br>GGCAAGATCATGTACGTGGGCGACGTGCGCAGCGTGACACAGAAGCACAT<br>CCAGGAGTGGGGACCCTTCGACCTGGTCATCGGAGGCAGCCCCTGTAATG<br>ACCTGTCCATCGTGAACCCTGCAAGGAAGGGCCTGTATGAGGGAACCGGC<br>AGACTGTTCTTTGAGTTCTACAGGCTGCTGCACGACGCCCGCCCTAAGGAG<br>GGCGATGACAGGCCATTCTTTTGGCTGTTTGAGAACGTGGTGGCCATGGGC<br>GTGAGCGACAAGCGGGATATCTCCAGATTCCTGGAGTCTAATCCCGTGATG<br>ATCGATGCAAAGGAGGTGTCTGCCGCACACAGGGCAAGGTACTTTTGGGG<br>AAATCTGCCTGGCATGAACCGCCCACTGGCCAGCACCGTGAACGACAAGC<br>TGGAGCTGCAGGAGTGCCTGGAGCACGGAAGGATCGCCAAGTTCTCCAAG<br>GTGCGGACAATCACCACAAGATCTAACAGCATCAAGCAGGGCAAGGATCA<br>GCACTTCCCCGTGTTCATGAATGAGAAGGAGGACATCCTGTGGTGTACCGA<br>GATGGAGCGCGTGTTCGGCTTTCCAGTGCACTATACAGACGTGAGCAATAT<br>GAGCCGGCTGGCAAGGCAGAGACTGCTGGGCCGGTCCTGGTCTGTGCCAG<br>TGATCAGACACCTGTTCGCCCCCCTGAAGGAGTACTTTGCCTGCGTGTCTA<br>GCGGCAACTCTAATGCCAACAGCAGAGGCCCTTCCTTTTCCTCTGGCCTGG<br>TGCCACTGTCTCTGAGGGGCAGCCACATGGGCCCCATGGAGATCTACAAG<br>ACCGTGTCCGCCTGGAAGAGGCAGCCTGTGCGCGTGCTGTCTCTGTTCCGC<br>AACATCGACAAGGTGCTGAAGAGCCTGGGCTTTCTGGAGAGCGGATCCGG<br>ATCTGGAGGAGGCACCCTGAAGTATGTGGAGGATGTGACAAATGTGGTGC<br>GGAGAGATGTGGAGAAGTGGGGCCCCTTCGATCTGGTGTACGGATCCACC<br>CAGCCACTGGGAAGCTCCTGCGATAGGTGTCCAGGATGGTATATGTTCCAG<br>TTTCACAGAATCCTGCAGTACGCACTGCCAAGGCAGGAGAGCCAGCGCCC<br>TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA<br>GGGGACGCGACTATCAGAATGCCATGCGGGTGTGGTCTAACATCCCTGGC<br>CTGAAGAGCAAGCACGCCCCCCTGACCCCTAAGGAGGAGGAGTACCTGCA<br>GGCCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC<br>AGAATAGCCTGCCACTGGGTGGACCTAGCTCTGGAGCCCCGCCTCCGTCAG<br>GTGGATCTCCTGCAGGTAGCCCAACTTCCACGGAAGAGGGCACGTCTGAG<br>AGTGCGACTCCTGAGAGCGGGCCTGGCACAAGTACTGAGCCCAGCGAAGG<br>TTCTGCACCCGGGTCTCCAGCTGGGAGCCCTACCTCAACAGAGGAAGGTAC<br>CAGCACAGAGCCTTCTGAGGGTAGCGCTCCTGGCACGTCCACCGAACCGTC<br>CGAGGGGATGGCACCGAAGAAAAAACGCAAAGTTGGTCGAGCGGCGATG<br>GCAGAACGCCCGTTCCAATGCAGAATATGTATGAGAAACTTCTCCCAGAG<br>CGGAAATCTGGCACGCCACATCCGGACACACACGGGAGAGAAGCCATTTG<br>CTTGTGACATTTGTGGTCGCAAATTTGCCGCCACCTGTTGTCTGGCACATCA<br>TACTAAGATACATACGGGGTCACAGAAACCATTCCAATGTAGGATCTGCAT<br>GCGGAATTTTTCTCGGTGGCAGTATTTGCCTACGCATATTAGAACCCACGC<br>CGGTGAGAAACCGTTTGCATGTGACATCTGCGGACGAAAGTTTGCCGATA<br>GATCTGCGCTTGCTAGGCATACTAAAATCCACACGGGGTCCCAGAAGCCTT<br>TTCAGTGTCGGATATGTATGAGGAACTTCAGTCGATCAGACAACCTTAGCG<br>AGCATATTCGGACGCATACTGGAGAAAAACCTTTTGCTTGTGATATATGCG<br>GTAGGAAGTTCGCCAAACGGTGTAACCTTCGCTGTCACACCAAATACATC<br>TTCGCCAGAAAGATGCGGCCCGGGCTCCGGACCGAAAAAAAAGAGAAAG<br>GTAAACGGCGGGGGAGGATCACGGACCCTGGTTACATTTAAGGACGTTTTT<br>GTAGACTTCACGAGGGAGGAATGGAAGCTGTTGGACACCGCCCAGCAAAT<br>CGTGTATCGAAATGTAATGTTGGAAAATTATAAAAATCTGGTTTCCCTCGG<br>CTACCAATTGACAAAACCAGACGTCATCCTCAGACTGGAAAAAGGGGAAG<br>AACCTTGGCTTGTCTGA | 3xFLAG-<br>DNMT3AL-<br>XTEN80-SV40<br>NLS-ZFP-SV40<br>NLS-KRAB<br>(DNA sequence) |
| 979 | ATGCACGATCAGGAGTTTGACCCCCCTAAGGTGTACCCACCCGTGCCAGCC<br>GAGAAGAGGAAGCCCATCCGCGTGCTGTCCCTGTTCGACGGCATCGCCAC<br>AGGCCTGCTGGTGCTGAAGGATCTGGGCATCCAGGTGGACAGATATATCG<br>CCTCCGAGGTGTGCGAGGATTCTATCACCGTGGGCATGGTGAGGCACCAG<br>GGCAAGATCATGTACGTGGGCGACGTGCGCAGCGTGACACAGAAGCACAT<br>CCAGGAGTGGGGACCCTTCGACCTGGTCATCGGAGGCAGCCCCTGTAATG<br>ACCTGTCCATCGTGAACCCTGCAAGGAAGGGCCTGTATGAGGGAACCGGC<br>AGACTGTTCTTTGAGTTCTACAGGCTGCTGCACGACGCCCGCCCTAAGGAG<br>GGCGATGACAGGCCATTCTTTTGGCTGTTTGAGAACGTGGTGGCCATGGGC<br>GTGAGCGACAAGCGGGATATCTCCAGATTCCTGGAGTCTAATCCCGTGATG<br>ATCGATGCAAAGGAGGTGTCTGCCGCACACAGGGCAAGGTACTTTTGGGG | 3xFLAG-<br>DNMT3AL-<br>XTEN80-SV40<br>NLS-ZFP-SV40<br>NLS-KRAB<br>(DNA sequence) |

TABLE E6-continued

DNMT3A/L-eZFP-KRAB fusion proteins

| SEQ ID NOs | Sequence | Description |
|---|---|---|
| | AAATCTGCCTGGCATGAACCGCCCACTGGCCAGCACCGTGAACGACAAGC<br>TGGAGCTGCAGGAGTGCCTGGAGCACGGAAGGATCGCCAAGTTCTCCAAG<br>GTGCGGACAATCACCACAAGATCTAACAGCATCAAGCAGGGCAAGGATCA<br>GCACTTCCCCGTGTTCATGAATGAGAAGGAGGACATCCTGTGGTGTACCGA<br>GATGGAGCGCGTGTTCGGCTTTCCAGTGCACTATACAGACGTGAGCAATAT<br>GAGCCGGCTGGCAAGGCAGAGACTGCTGGGCCGGTCCTGGTCTGTGCCAG<br>TGATCAGACACCTGTTCGCCCCCCTGAAGGAGTACTTTGCCTGCGTGTCTA<br>GCGGCAACTCTAATGCCAACAGCAGAGGCCCTTCCTTTTCCTCTGGCCTGG<br>TGCCACTGTCTCTGAGGGGCAGCCACATGGGCCCCATGGAGATCTACAAG<br>ACCGTGTCCGCCTGGAAGAGGCAGCCTGTGCGCGTGCTGTCTCTGTTCCGC<br>AACATCGACAAGGTGCTGAAGAGCCTGGCTTTCTGGAGAGCGGATCCGG<br>ATCTGGAGGAGGCACCCTGAAGTATGTGGAGGATGTGACAAATGTGGTGC<br>GGAGAGATGTGGAGAAGTGGGGCCCCTTCGATCTGGTGTACGGATCCACC<br>CAGCCACTGGGAAGCTCCTGCGATAGGTGTCCAGGATGGTATATGTTCCAG<br>TTTCACAGAATCCTGCAGTACGCACTGCCAAGGCAGGAGAGCCAGCGCCC<br>TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA<br>GGGGACGCGACTATCAGAATGCCATGCGGGTGTGGTCTAACATCCCTGGC<br>CTGAAGAGCAAGCACGCCCCCCTGACCCCTAAGGAGGAGGAGTACCTGCA<br>GGCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC<br>AGAATAGCCTGCCACTGGGTGGACCTAGCTCTGGAGCCCCGCCTCCGTCAG<br>GTGGATCTCCTGCAGGTAGCCCAACTTCCACGGAAGAGGGCACGTCTGAG<br>AGTGCGACTCCTGAGAGCGGGCCTGGCACAAGTACTGAGCCCAGCGAAGG<br>TTCTGCACCCGGGTCTCCAGCTGGGAGCCCTACCTCAACAGAGGAAGGTAC<br>CAGCACAGAGCCTTCTGAGGGTAGCGCTCCTGGCACGTCCACCGAACCGTC<br>CGAGGGGATGGCACCGAAGAAAAAACGCAAAGTTGGTCGAGCCGCTATGG<br>CTGAAAGACCATTCCAGTGCAGAATATGTATGAGGAATTTTTCTAATCCCG<br>CGAACCTTACGCGCCATATCAGGACGCACACGGGCGAAAAGCCCTTCGCC<br>TGCGACATTTGTGGGAGAAAGTTTGCTCAAAACGCGACCAGGACAAAGCA<br>CACGAAAATTCACACTGGTAGCCAGAAGCCGTTCCAGTGTAGGATCTGTAT<br>GCGCAATTTCTCTCAGTCCGGGCACCTCGCGCGACACATAAGAACTCATAC<br>GGGGGAGAAGCCGTTTGCATGTGACATCTGCGGCCGCAAGTTTGCGAATA<br>GGCATGACAGGGCAAAACATACGAAGATCCATACAGGTTCTCAAAAACCT<br>TTCCAATGTCGAATATGCATGCGCAACTTTAGTCGGTCAGACCACCTTTCT<br>GAACACATCAGGACACACACTGGCGAAAAGCCGTTCGCATGTGACATTTG<br>CGGCAGAAAGTTCGCACAAAGACGGTCCCGCTATAAGCACACCAAAATTC<br>ACCTTAGGCAAAAGGATGCAGCTCGGGCTCCGGACCGAAAAAAAGAGA<br>AAGGTAAACGGCGGGGAGGATCACGGACCCTGGTTACATTTAAGGACGT<br>TTTTGTAGACTTCACGAGGGAGGAATGGAAGCTGTTGGACACCGCCCAGC<br>AAATCGTGTATCGAAATGTAATGTTGGAAAATTATAAAAATCTGGTTTCCC<br>TCGGCTACCAATTGACAAAACCAGACGTCATCCTCAGACTGGAAAAAGGG<br>GAAGAACCTTGGCTTGTCTGA | |
| 980 | ATGCACGATCAGGAGTTTGACCCCCCTAAGGTGTACCCACCCGTGCCAGCC<br>GAGAAGAGGAAGCCCATCCGCGTGCTGTCCCTGTTCGACGGCATCGCCAC<br>AGGCCTGCTGGTGCTGAAGGATCTGGGCATCCAGGTGGACAGATATATCG<br>CCTCCGAGGTGTGCGAGGATTCTATCACCGTGGGCATGGTGAGGCACCAG<br>GGCAAGATCATGTACGTGGGCGACGTGCGCAGCGTGACACAGAAGCACAT<br>CCAGGAGTGGGGACCCTTCGACCTGGTCATCGGAGGCAGCCCCTGTAATG<br>ACCTGTCCATCGTGAACCCTGCAAGGAAGGGCCTGTATGAGGGAACCGGC<br>AGACTGTTCTTTGAGTTCTACAGGCTGCTGCACGACGCCCGCCCTAAGGAG<br>GGCGATGACAGGCCATTCTTTTGGCTGTTTGAGAACGTGGTGGCCATGGGC<br>GTGAGCGACAAGCGGGATATCTCCAGATTCCTGGAGTCTAATCCCGTGATG<br>ATCGATGCAAAGGAGGTGTCTGCCGCACACAGGGCAAGGTACTTTTGGGG<br>AAATCTGCCTGGCATGAACCGCCCACTGGCCAGCACCGTGAACGACAAGC<br>TGGAGCTGCAGGAGTGCCTGGAGCACGGAAGGATCGCCAAGTTCTCCAAG<br>GTGCGGACAATCACCACAAGATCTAACAGCATCAAGCAGGGCAAGGATCA<br>GCACTTCCCCGTGTTCATGAATGAGAAGGAGGACATCCTGTGGTGTACCGA<br>GATGGAGCGCGTGTTCGGCTTTCCAGTGCACTATACAGACGTGAGCAATAT<br>GAGCCGGCTGGCAAGGCAGAGACTGCTGGGCCGGTCCTGGTCTGTGCCAG<br>TGATCAGACACCTGTTCGCCCCCCTGAAGGAGTACTTTGCCTGCGTGTCTA<br>GCGGCAACTCTAATGCCAACAGCAGAGGCCCTTCCTTTTCCTCTGGCCTGG<br>TGCCACTGTCTCTGAGGGGCAGCCACATGGGCCCCATGGAGATCTACAAG<br>ACCGTGTCCGCCTGGAAGAGGCAGCCTGTGCGCGTGCTGTCTCTGTTCCGC<br>AACATCGACAAGGTGCTGAAGAGCCTGGCTTTCTGGAGAGCGGATCCGG<br>ATCTGGAGGAGGCACCCTGAAGTATGTGGAGGATGTGACAAATGTGGTGC<br>GGAGAGATGTGGAGAAGTGGGGCCCCTTCGATCTGGTGTACGGATCCACC<br>CAGCCACTGGGAAGCTCCTGCGATAGGTGTCCAGGATGGTATATGTTCCAG<br>TTTCACAGAATCCTGCAGTACGCACTGCCAAGGCAGGAGAGCCAGCGCCC<br>TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA<br>GGGGACGCGACTATCAGAATGCCATGCGGGTGTGGTCTAACATCCCTGGC<br>CTGAAGAGCAAGCACGCCCCCCTGACCCCTAAGGAGGAGGAGTACCTGCA | 3xFLAG-<br>DNMT3AL-<br>XTEN80-SV40<br>NLS-ZFP-SV40<br>NLS-KRAB<br>(DNA sequence) |

TABLE E6-continued

DNMT3A/L-eZFP-KRAB fusion proteins

| SEQ ID NOs | Sequence | Description |
|---|---|---|
|  | GGCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC<br>AGAATAGCCTGCCACTGGGTGGACCTAGCTCTGGAGCCCCGCCTCCGTCAG<br>GTGGATCTCCTGCAGGTAGCCCAACTTCCACGGAAGAGGGCACGTCTGAG<br>AGTGCGACTCCTGAGAGCGGGCCTGGCACAAGTACTGAGCCCAGCGAAGG<br>TTCTGCACCCGGGTCTCCAGCTGGGAGCCCTACCTCAACAGAGGAAGGTAC<br>CAGCACAGAGCCTTCTGAGGGTAGCGCTCCTGGCACGTCCACCGAACCGTC<br>CGAGGGGATGGCACCGAAGAAAAAACGCAAAGTTGGTCGAGCGGCAATG<br>GCAGAACGACCCTTCCAATGCCGCATATGTATGCGAAACTTCAGCCAGAG<br>CTCAGATCTTTCCAGACACATCAGGACTCACACTGGCGAAAAACCATTTGC<br>ATGCGATATATGCGGGAGAAAATTCGCGCACCGCAGTACGCGAAACAGGC<br>ATACAAAGATACATACTGGCAGTCAAAAGCCATTTCAATGTCGAATATGC<br>ATGAGGAACTTTAGTCGATCTGACGTGCTGAGCGCTCACATACGGACCCAT<br>ACCGGAGAGAAACCATTCGCTTGTGACATCTGTGGTAGGAAGTTCGCGGA<br>TTCCCGGACCCGCAAAAATCATACTAAAATTCACACTGGGTCTCAGAAGCC<br>CTTTCAGTGTAGGATATGTATGCGCAATTTTAGCCAGAGTGGTTCATTGAC<br>TCGGCATATCAGAACACATACTGGAGAGAAACCTTTCGCGTGTGATATTTG<br>CGGTCGAAAGTTCGCAGATCAGAGTGGACTTGCGCACCATACTAAGATCC<br>ACCTGAGACAGAAGGACGCTGCGCGGGCTCCGGACCGAAAAAAAAGAGA<br>AAGGTAAACGGCGGGGAGGATCACGGACCCTGGTTACATTTAAGGACGT<br>TTTTGTAGACTTCACGAGGGAGGAATGGAAGCTGTTGGACACCGCCCAGC<br>AAATCGTGTATCGAAATGTAATGTTGGAAAATTATAAAAATCTGGTTTCCC<br>TCGGCTACCAATTGACAAAACCAGACGTCATCCTCAGACTGGAAAAAGGG<br>GAAGAACCTTGGCTTGTCTGA |  |
| 981 | ATGCACGATCAGGAGTTTGACCCCCCTAAGGTGTACCCACCCGTGCCAGCC<br>GAGAAGAGGAAGCCCATCCGCGTGCTGTCCCTGTTCGACGGCATCGCCAC<br>AGGCCTGCTGGTGCTGAAGGATCTGGGCATCCAGGTGGACAGATATATCG<br>CCTCCGAGGTGTGCGAGGATTCTATCACCGTGGGCATGGTGAGGCACCAG<br>GGCAAGATCATGTACGTGGGCGACGTGCGCAGCGTGACACAGAAGCACAT<br>CCAGGAGTGGGGACCCTTCGACCTGGTCATCGGAGGCAGCCCTGTAATG<br>ACCTGTCCATCGTGAACCCTGCAAGGAAGGGCCTGTATGAGGGAACCGGC<br>AGACTGTTCTTTGAGTTCTACAGGCTGCTGCACGACGCCCGCCCTAAGGAG<br>GGCGATGACAGGCCATTCTTTTGGCTGTTTGAGAACGTGGTGGCCATGGGC<br>GTGAGCGACAAGCGGGATATCTCCAGATTCCTGGAGTCTAATCCCGTGATG<br>ATCGATGCAAAGGAGGTGTCTGCCGACACACAGGGCAAGGTACTTTTGGGG<br>AAATCTGCCTGGCATGAACCGCCCACTGGCCAGCACCGTGAACGACAAGC<br>TGGAGCTGCAGGAGTGCCTGGAGCACGGAAGGATCGCCAAGTTCTCCAAG<br>GTGCGGACAATCACCACAAGATCTAACAGCATCAAGCAGGGCAAGGATCA<br>GCACTTCCCCGTGTTCATGAATGAGAAGGAGGACATCCTGTGGTGTACCGA<br>GATGGAGCGCGTGTTCGGCTTTCCAGTGCACTATACAGACGTGAGCAATAT<br>GAGCCGGCTGGCAAGGCAGAGACTGCTGGGCCGGTCCTGGTCTGTGCCAG<br>TGATCAGACACCTGTTCGCCCCCCTGAAGGAGTACTTTGCCTGCGTGTCTA<br>GCGGCAACTCTAATGCCAACAGCAGAGGCCCTTCCTTTTCCTCTGGCCTGG<br>TGCCACTGTCTCTGAGGGGCAGCCACATGGGCCCCATGGAGATCTACAAG<br>ACCGTGTCCGCCTGGAAGAGGCAGCCTGTGCGCGTGCTGTCTCTGTTCCGC<br>AACATCGACAAGGTGCTGAAGAGCCTGGGCTTTCTGGAGAGCGGATCCGG<br>ATCTGGAGGAGGCACCCTGAAGTATGTGGAGGATGTGACAAATGTGGTGC<br>GGAGAGATGTGGAGAAGTGGGGCCCCTTCGATCTGGTGTACGGATCCACC<br>CAGCCACTGGGAAGCTCCTGCGATAGGTGTCCAGGATGGTATATGTTCCAG<br>TTTCACAGAATCCTGCAGTACGCACTGCCAAGGCAGGAGAGCCAGCGCCC<br>TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA<br>GGGGACGCGACTATCAGAATGCCATGCGGGTGTGGTCTAACATCCCTGGC<br>CTGAAGAGCAAGCACGCCCCCTGACCCCTAAGGAGGAGGAGTACCTGCA<br>GGCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC<br>AGAATAGCCTGCCACTGGGTGGACCTAGCTCTGGAGCCCCGCCTCCGTCAG<br>GTGGATCTCCTGCAGGTAGCCCAACTTCCACGGAAGAGGGCACGTCTGAG<br>AGTGCGACTCCTGAGAGCGGGCCTGGCACAAGTACTGAGCCCAGCGAAGG<br>TTCTGCACCCGGGTCTCCAGCTGGGAGCCCTACCTCAACAGAGGAAGGTAC<br>CAGCACAGAGCCTTCTGAGGGTAGCGCTCCTGGCACGTCCACCGAACCGTC<br>CGAGGGGATGGCACCGAAGAAAAAACGCAAAGTTGGTCGAGCTGCCATGG<br>CGGAGCGCCCTTTCCAGTGTAGGATATGTATGCGCAACTTCAGTCAGAACC<br>CAGCCCAGTGGCGGCACATACGGACGCATACTGGAGAAAGCCATTTGCA<br>TGTGATATCTGCGGGCGAAAATTCGCGCGGTCAGCAGATTTGAGCGGCAT<br>ACGAAGATCCATACAGGTTCACAAAAGCCATTTCAATGTCGGATATGTATG<br>CGGAACTTCAGCACGTCCGGCTCATTGTCAAGACATATACGAACTCATACC<br>GGAGAGAAACCCTTCGCGTGCGACATTTGCGGTCGGAAGTTCGCGCGATC<br>CGACCATCTGTCACGACATACGAAAATACACACTGGCTCTCAAAAGCCGTT<br>TCAGTGCAGAATTTGCATGAGAAATTTTAGCAGGAGCGACTCACTCCTTCG<br>GCATATACGAACACACACTGGTGAGAAGCCATTTGCCTGTGATATTTGTGG<br>ACGAAAGTTTGCGCAATCTTACGATAGGTTTCAGCATACAAAAATCCACCT<br>TCGGCAAAAGGACGCGGCACGGGCTCCGGACCGAAAAAAAGAGAAAGG | 3xFLAG-<br>DNMT3AL-<br>XTEN80-SV40<br>NLS-ZFP-SV40<br>NLS-KRAB<br>(DNA sequence) |

TABLE E6-continued

DNMT3A/L-eZFP-KRAB fusion proteins

| SEQ ID NOs | Sequence | Description |
|---|---|---|
| | TAAACGGCGGGGGAGGATCACGGACCCTGGTTACATTTAAGGACGTTTTTG TAGACTTCACGAGGGAGGAATGGAAGCTGTTGGACACCGCCCAGCAAATC GTGTATCGAAATGTAATGTTGGAAAATTATAAAAATCTGGTTTCCCTCGGC TACCAATTGACAAAACCAGACGTCATCCTCAGACTGGAAAAAGGGGAAGA ACCTTGGCTTGTCTGA | |
| 982 | ATGCACGATCAGGAGTTTGACCCCCCTAAGGTGTACCCACCCGTGCCAGCC GAGAAGAGGAAGCCCATCCGCGTGCTGTCCCTGTTCGACGGCATCGCCAC AGGCCTGCTGGTGCTGAAGGATCTGGGCATCCAGGTGGACAGATATATCG CCTCCGAGGTGTGCGAGGATTCTATCACCGTGGGCATGGTGAGGCACCAG GGCAAGATCATGTACGTGGGCGACGTGCGCAGCGTGACACAGAAGCACAT CCAGGAGTGGGGACCCTTCGACCTGGTCATCGGAGGCAGCCCCTGTAATG ACCTGTCCATCGTGAACCCTGCAAGGAAGGGCCTGTATGAGGGAACCGGC AGACTGTTCTTTGAGTTCTACAGGCTGCTGCACGACGCCCGCCCTAAGGAG GGCGATGACAGGCCATTCTTTTGGCTGTTTGAGAACGTGGTGGCCATGGGC GTGAGCGACAAGCGGGATATCTCCAGATTCCTGGAGTCTAATCCCGTGATG ATCGATGCAAAGGAGGTGTCTGCCGCACACAGGGCAAGGTACTTTTGGGG AAATCTGCCTGGCATGAACCGCCCACTGGCCAGCACCGTGAACGACAAGC TGGAGCTGCAGGAGTGCCTGGAGCACGGAAGGATCGCCAAGTTCTCCAAG GTGCGGACAATCACCACAAGATCTAACAGCATCAAGCAGGGCAAGGATCA GCACTTCCCCGTGTTCATGAATGAGAAGGAGGACATCCTGTGGTGTACCGA GATGGAGCGCGTGTTCGGCTTTCCAGTGCACTATACAGACGTGAGCAATAT GAGCCGGCTGGCAAGGCAGAGACTGCTGGGCCGGTCCTGGTCTGTGCCAG TGATCAGACACCTGTTCGCCCCCCTGAAGGAGTACTTTGCCTGCGTGTCTA GCGGCAACTCTAATGCCAACAGCAGAGGCCCTTCCTTTTCCTCTGGCCTGG TGCCACTGTCTCTGAGGGGCAGCCACATGGGCCCCATGGAGATCTACAAG ACCGTGTCCGCCTGGAAGAGGCAGCCTGTGCGCGTGCTGTCTCTGTTCCGC AACATCGACAAGGTGCTGAAGAGCCTGGGCTTTCTGGAGAGCGGATCCGG ATCTGGAGGAGGCACCCTGAAGTATGTGGAGGATGTGACAAATGTGGTGC GGAGAGATGTGGAGAAGTGGGGCCCCTTCGATCTGGTGTACGGATCCACC CAGCCACTGGGAAGCTCCTGCGATAGGTGTCCAGGATGGTATATGTTCCAG TTTCACAGAATCCTGCAGTACGCACTGCCAAGGCAGGAGAGCCAGCGCCC TTTCTTTTGGATCTTTATGGACAACCTGCTGCTGACAGAGGATGACCAGGA GACAACAACCCGCTTCCTGCAGACAGAGGCAGTGACCCTGCAGGATGTGA GGGGACGCGACTATCAGAATGCCATGCGGGTGTGGTCTAACATCCCTGGC CTGAAGAGCAAGCACGCCCCCCTGACCCCTAAGGAGGAGGATTACCTGCA GGCCCAGGTGCGGAGCAGATCCAAGCTGGATGCCCCTAAGGTGGACCTGC TGGTGAAGAATTGTCTGCTGCCACTGCGGGAGTACTTCAAGTACTTTAGTC AGAATAGCCTGCCACTGGGTGGACCTAGCTCTGGAGCCCCGCCTCCGTCAG GTGGATCTCCTGCAGGTAGCCCAACTTCACGGAAGAGGGCACGTCTGAG AGTGCGACTCCTGAGAGCGGGCCTGGCACAAGTACTGAGCCCAGCGAAGG TTCTGCACCCGGGTCTCCAGCTGGGAGCCCTACCTCAACAGAGGAAGGTAC CAGCACAGAGCCTTCTGAGGGTAGCGCTCCTGGCACGTCCACCGAACCGTC CGAGGGGATGGCACCGAAGAAAAAACGCAAAGTTGGTCGAGCTGCCATGG CTGAACGACCGTTTCAATGTCGAATTTGCATGCGCAACTTCTCCACGTCCG GGTCTCTCAGTAGACACATCAGAACGCATACTGGTGAAAAACCATTCGCTT GTGACATATGCGGCCGAAAATTCGCGCGGAGCGACCACCTGTCACGGCAT ACCAAAATTCACACCGGGAGTCAAAAACCGTTCCAGTGTAGGATATGTAT GCGCAACTTCAGCCGGTCTGACAGTCTGCTTCGACATATTCGGACGCACAC TGGTGAAAAGCCGTTTGCGTGCGACATTTGTGGTCGAAAGTTCGCTCAATC TTATGATAGGTTTCAACACACCAAAATACATACGGGCTCCCAGAAGCCGTT CCAGTGCAGAATATGCATGAGAAATTTCTCTCGCAGTGACAATTTGTCCAC CCATATTCGAACGCACACCGGCGAGAAACCCTTCGCCTGCGATATTTGCGG TCGCAAGTTCGCAGACAACAGGGATAGGATAAAACATACGAAGATCCATC TGAGGCAAAAAGACGCCGCCCGGGCTCCGGACCGAAAAAAAAGAGAAAG GTAAACGGCGGGGGAGGATCACGGACCCTGGTTACATTTAAGGACGTTTTT GTAGACTTCACGAGGGAGGAATGGAAGCTGTTGGACACCGCCCAGCAAAT CGTGTATCGAAATGTAATGTTGGAAAATTATAAAAATCTGGTTTCCCTCGG CTACCAATTGACAAAACCAGACGTCATCCTCAGACTGGAAAAAGGGGAAG AACCTTGGCTTGTCTGA | 3xFLAG-DNMT3AL-XTEN80-SV40 NLS-ZFP-SV40 NLS-KRAB (DNA sequence) |
| 983 | ATGCACGATCAGGAGTTTGACCCCCCTAAGGTGTACCCACCCGTGCCAGCC GAGAAGAGGAAGCCCATCCGCGTGCTGTCCCTGTTCGACGGCATCGCCAC AGGCCTGCTGGTGCTGAAGGATCTGGGCATCCAGGTGGACAGATATATCG CCTCCGAGGTGTGCGAGGATTCTATCACCGTGGGCATGGTGAGGCACCAT GGCAAGATCATGTACGTGGGCGACGTGCGCAGCGTGACACAGAAGCACAT CCAGGAGTGGGGACCCTTCGACCTGGTCATCGGAGGCAGCCCCTGTAATG ACCTGTCCATCGTGAACCCTGCAAGGAAGGGCCTGTATGAGGGAACCGGC AGACTGTTCTTTGAGTTCTACAGGCTGCTGCACGACGCCCGCCCTAAGGAG GGCGATGACAGGCCATTCTTTTGGCTGTTTGAGAACGTGGTGGCCATGGGC GTGAGCGACAAGCGGGATATCTCCAGATTCCTGGAGTCTAATCCCGTGATG ATCGATGCAAAGGAGGTGTCTGCCGCACACAGGGCAAGGTACTTTTGGGG AAATCTGCCTGGCATGAACCGCCCACTGGCCAGCACCGTGAACGACAAGC TGGAGCTGCAGGAGTGCCTGGAGCACGGAAGGATCGCCAAGTTCTCCAAG | 3xFLAG-DNMT3AL-XTEN80-SV40 NLS-ZFP-SV40 NLS-KRAB (DNA sequence) |

TABLE E6-continued

DNMT3A/L-eZFP-KRAB fusion proteins

| SEQ ID NOs | Sequence | Description |
|---|---|---|
| | GTGCGGACAATCACCACAAGATCTAACAGCATCAAGCAGGGCAAGGATCA<br>GCACTTCCCCGTGTTCATGAATGAGAAGGAGGACATCCTGTGGTGTACCGA<br>GATGGAGCGCGTGTTCGGCTTTCCAGTGCACTATACAGACGTGAGCAATAT<br>GAGCCGGCTGGCAAGGCAGAGACTGCTGGGCCGGTCCTGGTCTGTGCCAG<br>TGATCAGACACCTGTTCGCCCCCTGAAGGAGTACTTTGCCTGCGTGTCTA<br>GCGGCAACTCTAATGCCAACAGCAGAGGCCCTTCCTTTTCCTCTGGCCTGG<br>TGCCACTGTCTCTGAGGGGCAGCCACATGGGCCCCATGGAGATCTACAAG<br>ACCGTGTCCGCCTGGAAGAGGCAGCCTGTGCGCGTGCTGTCTCTGTTCCGC<br>AACATCGACAAGGTGCTGAAGAGCCTGGCTTTCTGGAGAGCGGATCCGG<br>ATCTGGAGGAGGCACCCTGAAGTATGTGGAGGATGTGACAAATGTGGTGC<br>GGAGAGATGTGGAGAAGTGGGGCCCCTTCGATCTGGTGTACGGATCCACC<br>CAGCCACTGGGAAGCTCCTGCGATAGGTGTCCAGGATGGTATATGTTCCAG<br>TTTCACAGAATCCTGCAGTACGCACTGCCAAGGCAGGAGAGCCAGCGCCC<br>TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA<br>GGGGACGCGACTATCAGAATGCCATGCGGGTGTGGTCTAACATCCCTGGC<br>CTGAAGAGCAAGCACGCCCCCTGACCCCTAAGGAGGAGGAGTACCTGCA<br>GGCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC<br>AGAATAGCCTGCCACTGGGTGGACCTAGCTCTGGAGCCCCGCCTCCGTCAG<br>GTGGATCTCCTGCAGGTAGCCCAACTTCCACGGAAGAGGGCACGTCTGAG<br>AGTGCGACTCCTGAGAGCGGGCCTGGCACAAGTACTGAGCCCAGCGAAGG<br>TTCTGCACCCGGGTCTCCAGCTGGGAGCCCTACCTCAACAGAGGAAGGTAC<br>CAGCACAGAGCCTTCTGAGGGTAGCGCTCCTGGCACGTCCACCGAACCGTC<br>CGAGGGGATGGCACCGAAGAAAAAACGCAAAGTTGGTCGAGCAGCCATG<br>GCAGAGCGGCCATTCCAGTGCAGAATCTGCATGCGGAACTTTTCCGATAGG<br>TCCAATCTGTCACGCCATATTAGGACACACACGGGTGAAAAACCGTTCGCG<br>TGTGACATATGCGGTCGCAAATTCGCCCTGAGACAGAACCTGATTATGCAC<br>ACAAAAATACATACGGGAAGCCAGAAACCGTTCCAGTGTCGGATATGCAT<br>GAGGAACTTCAGTGAGAGGGGACTTTGGCGAGGCACATCAGGACTCACA<br>CTGGGGAGAAGCCCTTTGCATGTGATATCTGTGGCCGAAAATTTGCTCGAT<br>CAGATGCTCTCACCCAACATACAAAGATCCATACTGGCTCTCAAAAACCGT<br>TTCAATGTAGAATTTGTATGCGCAACTTCTCTCGGTCAGATAGCCTGTCCC<br>AGCATATCCGAACTCATACAGGTGAGAAACCCTTCGCATGCGACATCTGTG<br>GGCGAAAATTTGCTAGAAAAGCAGACCGGACCCGACACACAAAGATTCAT<br>CTGCGACAAAAAGACGCCGCCCGGGCTCCGGACCGAAAAAAAGAGAAA<br>GGTAAACGGCGGGGAGGATCACGGACCCTGGTTACATTTAAGGACGTTT<br>TTGTAGACTTCACGAGGGAGGAATGGAAGCTGTTGGACACCGCCCAGCAA<br>ATCGTGTATCGAAATGTAATGTTGGAAAATTATAAAAATCTGGTTTCCCTC<br>GGCTACCAATTGACAAAACCAGACGTCATCCTCAGACTGGAAAAAGGGGA<br>AGAACCTTGGCTTGTCTGA | |
| 984 | ATGCACGATCAGGAGTTTGACCCCCCTAAGGTGTACCCACCCGTGCCAGCC<br>GAGAAGAGGAAGCCCATCCGCGTGCTGTCCCTGTTCGACGGCATCGCCAC<br>AGGCCTGCTGGTGCTGAAGGATCTGGGCATCCAGGTGGACAGATATATCG<br>CCTCCGAGGTGTGCGAGGATTCTATCACCGTGGGCATGGTGAGGCACCAG<br>GGCAAGATCATGTACGTGGGCGACGTGCGCAGCGTGACACAGAAGCACAT<br>CCAGGAGTGGGGACCCTTCGACCTGGTCATCGGAGGCAGCCCCTGTAATG<br>ACCTGTCCATCGTGAACCCTGCAAGGAAGGGCCTGTATGAGGGAACCGGC<br>AGACTGTTCTTTGAGTTCTACAGGCTGCTGCACGACGCCCGCCCTAAGGAG<br>GGCGATGACAGGCCATTCTTTTGGCTGTTTGAGAACGTGGTGGCCATGGGC<br>GTGAGCGACAAGCGGGATATCTCCAGATTCCTGGAGTCTAATCCCGTGATG<br>ATCGATGCAAAGGAGGTGTCTGCCGCACACAGGGCAAGGTACTTTTGGGG<br>AAATCTGCCTGGCATGAACCGCCCACTGGCCAGCACCGTGAACGACAAGC<br>TGGAGCTGCAGGAGTGCCTGGAGCACGGAAGGATCGCCAAGTTCTCCAAG<br>GTGCGGACAATCACCACAAGATCTAACAGCATCAAGCAGGGCAAGGATCA<br>GCACTTCCCCGTGTTCATGAATGAGAAGGAGGACATCCTGTGGTGTACCGA<br>GATGGAGCGCGTGTTCGGCTTTCCAGTGCACTATACAGACGTGAGCAATAT<br>GAGCCGGCTGGCAAGGCAGAGACTGCTGGGCCGGTCCTGGTCTGTGCCAG<br>TGATCAGACACCTGTTCGCCCCCTGAAGGAGTACTTTGCCTGCGTGTCTA<br>GCGGCAACTCTAATGCCAACAGCAGAGGCCCTTCCTTTTCCTCTGGCCTGG<br>TGCCACTGTCTCTGAGGGGCAGCCACATGGGCCCCATGGAGATCTACAAG<br>ACCGTGTCCGCCTGGAAGAGGCAGCCTGTGCGCGTGCTGTCTCTGTTCCGC<br>AACATCGACAAGGTGCTGAAGAGCCTGGCTTTCTGGAGAGCGGATCCGG<br>ATCTGGAGGAGGCACCCTGAAGTATGTGGAGGATGTGACAAATGTGGTGC<br>GGAGAGATGTGGAGAAGTGGGGCCCCTTCGATCTGGTGTACGGATCCACC<br>CAGCCACTGGGAAGCTCCTGCGATAGGTGTCCAGGATGGTATATGTTCCAG<br>TTTCACAGAATCCTGCAGTACGCACTGCCAAGGCAGGAGAGCCAGCGCCC<br>TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA<br>GGGGACGCGACTATCAGAATGCCATGCGGGTGTGGTCTAACATCCCTGGC<br>CTGAAGAGCAAGCACGCCCCCTGACCCCTAAGGAGGAGGAGTACCTGCA<br>GGCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC | 3xFLAG-<br>DNMT3AL-<br>XTEN80-SV40<br>NLS-ZFP-SV40<br>NLS-KRAB<br>(DNA sequence) |

TABLE E6-continued

DNMT3A/L-eZFP-KRAB fusion proteins

| SEQ ID NOs | Sequence | Description |
|---|---|---|
|  | AGAATAGCCTGCCACTGGGTGGACCTAGCTCTGGAGCCCCGCCTCCGTCAG<br>GTGGATCTCCTGCAGGTAGCCCAACTTCCACGGAAGAGGGCACGTCTGAG<br>AGTGCGACTCCTGAGAGCGGGCCTGGCACAAGTACTGAGCCCAGCGAAGG<br>TTCTGCACCCGGGTCTCCAGCTGGGAGCCCTACCTCAACAGAGGAAGGTAC<br>CAGCACAGAGCCTTCTGAGGGTAGCGCTCCTGGCACGTCCACCGAACCGTC<br>CGAGGGGATGGCACCGAAGAAAAAACGCAAAGTTGGTCGAGCGGCCATG<br>GCTGAGAGGCCTTTTCAATGTAGAATATGTATGCGAAATTTTTCACAGTAC<br>TGTTGTCTCACGAACCACATAAGGACTCATACAGGGGAGAAACCATTTGCC<br>TGTGACATTTGCGGTCGCAAATTTGCTACTTCTGGAAACCTGACTCGGCAC<br>ACTAAGATTCACACAGGGTCCCAGAAGCCCTTCCAGTGTCGCATTTGCATG<br>AGGAATTTTAGTCAAAGCTCTGACTTGTCAAGGCATATTCGCACGCACACG<br>GGCGAAAAGCCGTTCGCTTGCGACATATGCGGGCGGAAATTTGCCTTCCGC<br>TATTATTTGAAGAGACACACCAAGATACATACGGGCTCTCAGAAGCCCTTT<br>CAGTGTAGGATTTGCATGCGCAATTTTTCACAATCTGGTGATCTCACGCGA<br>CACATCCGGACTCACACAGGTGAAAAGCCTTTCGCGTGCGACATTTGCGGC<br>CGGAAGTTTGCTGACAAGGGCAACCTCACAAAGCATACGAAGATTCACTT<br>GAGGCAGAAAGATGCTGCTCGGGCTCCGGACCGAAAAAAAAGAGAAGG<br>TAAACGGCGGGGAGGATCACGGACCCTGGTTACATTTAAGGACGTTTTTG<br>TAGACTTCACGAGGGAGGAATGGAAGCTGTTGGACACCGCCCAGCAAATC<br>GTGTATCGAAATGTAATGTTGGAAAATTATAAAAATCTGGTTTCCCTCGGC<br>TACCAATTGACAAAACCAGACGTCATCCTCAGACTGGAAAAAGGGGAAGA<br>ACCTTGGCTTGTCTGA |  |
| 985 | ATGCACGATCAGGAGTTTGACCCCCCTAAGGTGTACCCACCCGTGCCAGCC<br>GAGAAGAGGAAGCCCATCCGCGTGCTGTCCCTGTTCGACGGCATCGCCAC<br>AGGCCTGCTGGTGCTGAAGGATCTGGGCATCCAGGTGGACAGATATATCG<br>CCTCCGAGGTGTGCGAGGATTCTATCACCGTGGGCATGGTGAGGCACCAG<br>GGCAAGATCATGTACGTGGGCGACGTGCGCAGCGTGACACAGAAGCACAT<br>CCAGGAGTGGGGACCCTTCGACCTGGTCATCGGAGGCAGCCCCTGTAATG<br>ACCTGTCCATCGTGAACCCTGCAAGGAAGGGCCTGTATGAGGGAACCGGC<br>AGACTGTTCTTTGAGTTCTACAGGCTGCTGCACGACGCCCGCCCTAAGGAG<br>GGCGATGACAGGCCATTCTTTTGGCTGTTTGAGAACGTGGTGGCCATGGGC<br>GTGAGCGACAAGCGGGATATCTCCAGATTCCTGGAGTCTAATCCCGTGATG<br>ATCGATGCAAAGGAGGTGTCTGCCGCACACAGGGCAAGGTACTTTTGGGG<br>AAATCTGCCTGGCATGAACCGCCCACTGGCCAGCACCGTGAACGACAAGC<br>TGGAGCTGCAGGAGTGCCTGGAGCACGGAAGGATCGCCAAGTTCTCCAAG<br>GTGCGGACAATCACCACAAGATCTAACAGCATCAAGCAGGGCAAGGATCA<br>GCACTTCCCCGTGTTCATGAATGAGAAGGAGGACATCCTGTGGTGTACCGA<br>GATGGAGCGCGTGTTCGGCTTTCCAGTGCACTATACAGACGTGAGCAATAT<br>GAGCCGGCTGGCAAGGCAGAGACTGCTGGGCCGGTCCTGGTCTGTGCCAG<br>TGATCAGACACCTGTTCGCCCCCCTGAAGGAGTACTTTGCCTGCGTGTCTA<br>GCGGCAACTCTAATGCCAACAGCAGAGGCCCTTCCTTTTCCTCTGGCCTGG<br>TGCCACTGTCTCTGAGGGGCAGCCACATGGGCCCCATGGAGATCTACAAG<br>ACCGTGTCCGCCTGGAAGAGGCAGCCTGTGCGCGTGCTGTCTCTGTTCCGC<br>AACATCGACAAGGTGCTGAAGAGCCTGGCTTTCTGGAGAGCGGATCCGG<br>ATCTGGAGGAGGCACCCTGAAGTATGTGGAGGATGTGACAAATGTGGTGC<br>GGAGAGATGTGGAGAAGTGGGGCCCCTTCGATCTGGTGTACGGATCCACC<br>CAGCCACTGGGAAGCTCCTGCGATAGGTGTCCAGGATGGTATATGTTCCAG<br>TTTCACAGAATCCTGCAGTACGCACTGCCAAGGCAGGAGAGCCAGCGCCC<br>TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA<br>GGGGACGCGACTATCAGAATGCCATGCGGGTGTGGTCTAACATCCCTGGC<br>CTGAAGAGCAAGCACGCCCCCTGACCCCTAAGGAGGAGGAGTACCTGCA<br>GGCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC<br>AGAATAGCCTGCCACTGGGTGGACCTAGCTCTGGAGCCCCGCCTCCGTCAG<br>GTGGATCTCCTGCAGGTAGCCCAACTTCCACGGAAGAGGGCACGTCTGAG<br>AGTGCGACTCCTGAGAGCGGGCCTGGCACAAGTACTGAGCCCAGCGAAGG<br>TTCTGCACCCGGGTCTCCAGCTGGGAGCCCTACCTCAACAGAGGAAGGTAC<br>CAGCACAGAGCCTTCTGAGGGTAGCGCTCCTGGCACGTCCACCGAACCGTC<br>CGAGGGGATGGCACCGAAGAAAAAACGCAAAGTTGGTCGAGCGGCCATG<br>GCCGAACGACCATTCCAGTGCAGGATATGTATGCGCAATTTTTCAACCAGT<br>GGTTCATTGTCACGACATATTAGAACACACACCGGTGAGAAACCCTTTGCG<br>TGTGACATCTGTGGGAGGAAATTCGCAAGATCTGACAACCTTACGACACAT<br>ACAAAGATTCACACAGGCTCTCAAAAGCCCTTCCAGTGCCGAATTTGCATG<br>CGAAACTTTTCCCAGTCTGGTAATCTCGCTCGACATATCAGAACCCACACG<br>GGGGAAAAACCATTCGCTTGTGATATTTGCGGACGAAAGTTCGCCGACAG<br>AACCACACTCATGAGACACACTAAAATCCATACTGGTAGTCAGAAGCCGT<br>TTCAGTGTAGAATCTGCATGAGGAACTTTTCCCAGTCAGGCCACCTTGCAA<br>GACATATACGAACTCACACTGGAGAAAAGCCGTTCGCCTGTGACATTTGTG<br>GGCGCAAGTTCGCGCAACTCACCCATCTGAATAGCCATACGAAGATTCACT<br>TGAGACAGAAAGATGCGGCTCGGGCTCCGGACCGAAAAAAAAGAGAAAG<br>GTAAACGGCGGGGAGGATCACGGACCCTGGTTACATTTAAGGACGTTTTT<br>GTAGACTTCACGAGGGAGGAATGGAAGCTGTTGGACACCGCCCAGCAAAT | 3xFLAG-<br>DNMT3AL-<br>XTEN80-SV40<br>NLS-ZFP-SV40<br>NLS-KRAB<br>(DNA sequence) |

TABLE E6-continued

DNMT3A/L-eZFP-KRAB fusion proteins

| SEQ ID NOs | Sequence | Description |
|---|---|---|
|  | CGTGTATCGAAATGTAATGTTGGAAAATTATAAAAATCTGGTTTCCCTCGG CTACCAATTGACAAAACCAGACGTCATCCTCAGACTGGAAAAGGGGAAG AACCTTGGCTTGTCTGA | |
| 986 | ATGCACGATCAGGAGTTTGACCCCCCTAAGGTGTACCCACCCGTGCCAGCC GAGAAGAGGAAGCCCATCCGCGTGCTGTCCCTGTTCGACGGCATCGCCAC AGGCCTGCTGGTGCTGAAGGATCTGGGCATCCAGGTGGACAGATATATCG CCTCCGAGGTGTGCGAGGATTCTATCACCGTGGGCATGGTGAGGCACCAG GGCAAGATCATGTACGTGGGCGACGTGCGCAGCGTGACACAGAAGCACAT CCAGGAGTGGGGACCCTTCGACCTGGTCATCGGAGGCAGCCCCTGTAATG ACCTGTCCATCGTGAACCCTGCAAGGAAGGGCCTGTATGAGGGAACCGGC AGACTGTTCTTTGAGTTCTACAGGCTGCTGCACGACGCCCGCCCTAAGGAG GGCGATGACAGGCCATTCTTTTGGCTGTTTGAGAACGTGGTGGCCATGGGC GTGAGCGACAAGCGGGATATCTCCAGATTCCTGGAGTCTAATCCCGTGATG ATCGATGCAAAGGAGGTGTCTGCCGCACACAGGGCAAGGTACTTTTGGGG AAATCTGCCTGGCATGAACCGCCCACTGGCCAGCACCGTGAACGACAAGC TGGAGCTGCAGGAGTGCCTGGAGCACGGAAGGATCGCCAAGTTCTCCAAG GTGCGGACAATCACCACAAGATCTAACAGCATCAAGCAGGGCAAGGATCA GCACTTCCCCGTGTTCATGAATGAGAAGGAGGACATCCTGTGGTGTACCGA GATGGAGCGCGTGTTCGGCTTTCCAGTGCACTATACAGACGTGAGCAATAT GAGCCGGCTGGCAAGGCAGAGACTGCTGGGCCGGTCCTGGTCTGTGCCAG TGATCAGACACCTGTTCGCCCCCCTGAAGGAGTACTTTGCCTGCGTGTCTA GCGGCAACTCTAATGCCAACAGCAGAGGCCCTTCCTTTTTCCTCTGGCCTGG TGCCACTGTCTCTGAGGGGCAGCCACATGGGCCCCATGGAGATCTACAAG ACCGTGTCCGCCTGGAAGAGGCAGCCTGTGCGCGTGCTGTCTCTGTTCCGC AACATCGACAAGGTGCTGAAGAGCCTGGGCTTTCTGGAGAGCGGATCCGG ATCTGGAGGAGGCACCCTGAAGTATGTGGAGGATGTGACAAATGTGGTGC GGAGAGATGTGGAGAAGTGGGGCCCCTTCGATCTGGTGTACGGATCCACC CAGCCACTGGGAAGCTCCTGCGATAGGTGTCCAGGATGGTATATGTTCCAG TTTCACAGAATCCTGCAGTACGCACTGCCAAGGCAGGAGAGCCAGCGCCC TTTCTTTTGGATCTTTATGGACAACCTGCTGCTGACAGAGGATGACCAGGA GACAACAACCCGCTTCCTGCAGACAGAGGCAGTGACCCTGCAGGATGTGA GGGGACGCGACTATCAGAATGCCATGCGGGTGTGGTCTAACATCCCTGGC CTGAAGAGCAAGCACGCCCCCCTGACCCCTAAGGAGGAGGAGTACCTGCA GGCCCAGGTGCGGAGCAGATCCAAGCTGGATGCCCCTAAGGTGGACCTGC TGGTGAAGAATTGTCTGCTGCCACTGCGGGAGTACTTCAAGTACTTTAGTC AGAATAGCCTGCCACTGGGTGGACCTAGCTCTGGAGCCCCGCCTCCGTCAG GTGGATCTCCTGCAGGTAGCCCAACTTCCACGGAAGAGGGCACGTCTGAG AGTGCGACTCCTGAGAGCGGGCCTGGCACAAGTACTGAGCCCAGCGAAGG TTCTGCACCCGGGTCTCCAGCTGGGAGCCCTACCTCAACAGAGGAAGGTAC CAGCACAGAGCCTTCTGAGGGTAGCGCTCCTGGCACGTCCACCGAACCGTC CGAGGGGATGGCACCGAAGAAAAAACGCAAAGTTGGTCGAGCAGCTATG GCTGAACGCCCATTCCAGTGTCGGATCTGCATGCGCAACTTTTCTATAAAA CACGATCTTCACCGACACATTCGGACACATACTGGGGAGAAGCCCTTTGCG TGTGACATCTGTGGCCGAAAGTTCGCTAGATCCGCAAACTTGACTCGGCAT ACGAAAATTCACACTGGAAGCCAGAAACCTTTCCAATGTCGAATCTGTATG AGGAACTTTAGCAGAAGTGATAATCTCGCCAGGCATATCCGAACGCACAC AGGCGAGAAGCCATTCGCATGTGATATTTGTGGTAGAAAGTTCGCCCAAA ATGTCTCTCGCCCACGCCATACTAAGATCCACACGGGCTCCCAGAAGCCGT TCCAATGCCGCATTTGCATGCGAAACTTTTCCAGATCAGACGATCTGAGCA AGCATATTAGGACGCATACAGGGGAGAAGCCTTTTGCTTGCGACATTTGCG GCCGGAAATTTGCTGACTCAAGTCACAGAACACGGCATACCAAGATACAC CTTCGACAAAAGATGCCGCACGGGCTCCGGACCGAAAAAAAAGAGAAA GGTAAACGGCGGGGAGGATCACGGACCCTGGTTACATTTAAGGACGTTT TTGTAGACTTCACGAGGGAGGAATGGAAGCTGTTGGACACCGCCCAGCAA ATCGTGTATCGAAATGTAATGTTGGAAAATTATAAAAATCTGGTTTCCCTC GGCTACCAATTGACAAAACCAGACGTCATCCTCAGACTGGAAAAGGGGA AGAACCTTGGCTTGTCTGA | 3xFLAG-DNMT3AL-XTEN80-SV40 NLS-ZFP-SV40 NLS-KRAB (DNA sequence) |
| 987 | ATGCACGATCAGGAGTTTGACCCCCCTAAGGTGTACCCACCCGTGCCAGCC GAGAAGAGGAAGCCCATCCGCGTGCTGTCCCTGTTCGACGGCATCGCCAC AGGCCTGCTGGTGCTGAAGGATCTGGGCATCCAGGTGGACAGATATATCG CCTCCGAGGTGTGCGAGGATTCTATCACCGTGGGCATGGTGAGGCACCAG GGCAAGATCATGTACGTGGGCGACGTGCGCAGCGTGACACAGAAGCACAT CCAGGAGTGGGGACCCTTCGACCTGGTCATCGGAGGCAGCCCCTGTAATG ACCTGTCCATCGTGAACCCTGCAAGGAAGGGCCTGTATGAGGGAACCGGC AGACTGTTCTTTGAGTTCTACAGGCTGCTGCACGACGCCCGCCCTAAGGAG GGCGATGACAGGCCATTCTTTTGGCTGTTTGAGAACGTGGTGGCCATGGGC GTGAGCGACAAGCGGGATATCTCCAGATTCCTGGAGTCTAATCCCGTGATG ATCGATGCAAAGGAGGTGTCTGCCGCACACAGGGCAAGGTACTTTTGGGG AAATCTGCCTGGCATGAACCGCCCACTGGCCAGCACCGTGAACGACAAGC TGGAGCTGCAGGAGTGCCTGGAGCACGGAAGGATCGCCAAGTTCTCCAAG GTGCGGACAATCACCACAAGATCTAACAGCATCAAGCAGGGCAAGGATCA GCACTTCCCCGTGTTCATGAATGAGAAGGAGGACATCCTGTGGTGTACCGA | 3xFLAG-DNMT3AL-XTEN80-SV40 NLS-ZFP-SV40 NLS-KRAB (DNA sequence) |

TABLE E6-continued

DNMT3A/L-eZFP-KRAB fusion proteins

| SEQ ID NOs | Sequence | Description |
|---|---|---|
| | GATGGAGCGCGTGTTCGGCTTTCCAGTGCACTATACAGACGTGAGCAATAT<br>GAGCCGGCTGGCAAGGCAGAGACTGCTGGGCCGGTCCTGGTCTGTGCCAG<br>TGATCAGACACCTGTTCGCCCCCCTGAAGGAGTACTTTGCCTGCGTGTCTA<br>GCGGCAACTCTAATGCCAACAGCAGAGGCCCTTCCTTTTCCTCTGGCCTGG<br>TGCCACTGTCTCTGAGGGGCAGCCACATGGGCCCCATGGAGATCTACAAG<br>ACCGTGTCCGCCTGGAAGAGGCAGCCTGTGCGCGTGCTGTCTCTGTTCCGC<br>AACATCGACAAGGTGCTGAAGAGCCTGGGCTTTCTGGAGAGCGGATCCGG<br>ATCTGGAGGAGGCACCCTGAAGTATGTGGAGGATGTGACAAATGTGGTGC<br>GGAGAGATGTGGAGAAGTGGGGCCCCTTCGATCTGGTGTACGGATCCACC<br>CAGCCACTGGGAAGCTCCTGCGATAGGTGTCCAGGATGGTATATGTTCCAG<br>TTTCACAGAATCCTGCAGTACGCACTGCCAAGGCAGGAGAGCCAGCGCCC<br>TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA<br>GGGGACGCGACTATCAGAATGCCATGCGGGTGTGGTCTAACATCCCTGGC<br>CTGAAGAGCAAGCACGCCCCCCTGACCCCTAAGGAGGAGGAGTACCTGCA<br>GGCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC<br>AGAATAGCCTGCCACTGGGTGGACCTAGCTCTGGAGCCCCGCCTCCGTCAG<br>GTGGATCTCCTGCAGGTAGCCCAACTTCCACGGAAGAGGGCACGTCTGAG<br>AGTGCGACTCCTGAGAGCGGGCCTGGCACAAGTACTGAGCCCAGCGAAGG<br>TTCTGCACCCGGGTCTCCAGCTGGGAGCCCTACCTCAACAGAGGAAGGTAC<br>CAGCACAGAGCCTTCTGAGGGTAGCGCTCCTGGCACGTCCACCGAACCGTC<br>CGAGGGGATGGCACCGAAGAAAAAACGCAAAGTTGGTCGAGCGGCCATG<br>GCGGAACGACCCTTTCAGTGCCGAATTTGCATGAGGAACTTTTCACGATCT<br>GATAACCTGGCGAGGCACATCCGAACACATACGGGCGAGAAGCCATTCGC<br>ATGTGATATCTGCGGGCGAAAGTTCGCCCAAAATGTCAGTAGACCGCGAC<br>ATACTAAAATACACACTGGCTCACAGAAGCCGTTCCAATGCCGCATCTGTA<br>TGCGCAATTTTTCCCGAAGCGACGATCTGTCTAAACATATTCGGACGCACA<br>CTGGGGAAAAGCCTTTCGCTTGTGACATCTGTGGGAGGAAGTTCGCTGACA<br>GCTCTCATAGGACACGCCATACTAAGATTCATACCGGAAGCCAGAAGCCTT<br>TCCAGTGTCGGATTTGCATGAGAAACTTTAGCACTTCTAGCAACAGAAAGA<br>CACATATACGAACCCATACGGGTGAGAAACCGTTCGCATGCGATATCTGTG<br>GGCGAAAATTTGCAGCCCAATGGACCAGAGCTTGCCATACCAAGATACAC<br>CTTCGGCAGAAGGACGCTGCACGGGCTCCGGACCGAAAAAAAAGAGAAA<br>GGTAAACGGCGGGGAGGATCACGGACCCTGGTTACATTTAAGGACGTTT<br>TTGTAGACTTCACGAGGGAGGAATGGAAGCTGTTGGACACCGCCCAGCAA<br>ATCGTGTATCGAAATGTAATGTTGGAAAATTATAAAAATCTGGTTTCCCTC<br>GGCTACCAATTGACAAAACCAGACGTCATCCTCAGACTGGAAAAAGGGGA<br>AGAACCTTGGCTTGTCTGA | |
| 988 | ATGCACGATCAGGAGTTTGACCCCCCTAAGGTGTACCCACCCGTGCCAGCC<br>GAGAAGAGGAAGCCCATCCGCGTGCTGTCCCTGTTCGACGGCATCGCCAC<br>AGGCCTGCTGGTGCTGAAGGATCTGGGCATCCAGGTGGACAGATATATCG<br>CCTCCGAGGTGTGCGAGGATTCTATCACCGTGGGCATGGTGAGGCACCAG<br>GGCAAGATCATGTACGTGGGCGACGTGCGCAGCGTGACACAGAAGCACAT<br>CCAGGAGTGGGGACCCTTCGACCTGGTCATCGGAGGCAGCCCCTGTAATG<br>ACCTGTCCATCGTGAACCCTGCAAGGAAGGGCCTGTATGAGGGAACCGGC<br>AGACTGTTCTTTGAGTTCTACAGGCTGCTGCACGACGCCCGCCCTAAGGAG<br>GGCGATGACAGGCCATTCTTTTGGCTGTTTGAGAACGTGGTGGCCATGGGC<br>GTGAGCGACAAGCGGGATATCTCCAGATTCCTGGAGTCTAATCCCGTGATG<br>ATCGATGCAAAGGAGGTGTCTGCCGCACACAGGGCAAGGTACTTTTGGGG<br>AAATCTGCCTGGCATGAACCGCCCACTGGCCAGCACCGTGAACGACAAGC<br>TGGAGCTGCAGGAGTGCCTGGAGCACGGAAGGATCGCCAAGTTCTCCAAG<br>GTGCGGACAATCACCACAAGATCTAACAGCATCAAGCAGGGCAAGGATCA<br>GCACTTCCCCGTGTTCATGAATGAGAAGGAGGACATCCTGTGGTGTACCGA<br>GATGGAGCGCGTGTTCGGCTTTCCAGTGCACTATACAGACGTGAGCAATAT<br>GAGCCGGCTGGCAAGGCAGAGACTGCTGGGCCGGTCCTGGTCTGTGCCAG<br>TGATCAGACACCTGTTCGCCCCCCTGAAGGAGTACTTTGCCTGCGTGTCTA<br>GCGGCAACTCTAATGCCAACAGCAGAGGCCCTTCCTTTTCCTCTGGCCTGG<br>TGCCACTGTCTCTGAGGGGCAGCCACATGGGCCCCATGGAGATCTACAAG<br>ACCGTGTCCGCCTGGAAGAGGCAGCCTGTGCGCGTGCTGTCTCTGTTCCGC<br>AACATCGACAAGGTGCTGAAGAGCCTGGGCTTTCTGGAGAGCGGATCCGG<br>ATCTGGAGGAGGCACCCTGAAGTATGTGGAGGATGTGACAAATGTGGTGC<br>GGAGAGATGTGGAGAAGTGGGGCCCCTTCGATCTGGTGTACGGATCCACC<br>CAGCCACTGGGAAGCTCCTGCGATAGGTGTCCAGGATGGTATATGTTCCAG<br>TTTCACAGAATCCTGCAGTACGCACTGCCAAGGCAGGAGAGCCAGCGCCC<br>TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA<br>GGGGACGCGACTATCAGAATGCCATGCGGGTGTGGTCTAACATCCCTGGC<br>CTGAAGAGCAAGCACGCCCCCCTGACCCCTAAGGAGGAGGAGTACCTGCA<br>GGCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC<br>AGAATAGCCTGCCACTGGGTGGACCTAGCTCTGGAGCCCCGCCTCCGTCAG<br>GTGGATCTCCTGCAGGTAGCCCAACTTCCACGGAAGAGGGCACGTCTGAG | 3xFLAG-<br>DNMT3AL-<br>XTEN80-SV40<br>NLS-ZFP-SV40<br>NLS-KRAB<br>(DNA sequence) |

TABLE E6-continued

DNMT3A/L-eZFP-KRAB fusion proteins

| SEQ ID NOs | Sequence | Description |
|---|---|---|
|  | AGTGCGACTCCTGAGAGCGGGCCTGGCACAAGTACTGAGCCCAGCGAAGG TTCTGCACCCGGGTCTCCAGCTGGGAGCCCTACCTCAACAGAGGAAGGTAC CAGCACAGAGCCTTCTGAGGGTAGCGCTCCTGGCACGTCCACCGAACCGTC CGAGGGGATGGCACCGAAGAAAAAACGCAAAGTTGGTCGAGCTGCGATG GCAGAACGACCTTTTCAATGCCGAATTTGTATGAGGAACTTTTCCCGGTCA GACGACCTTTCCAAGCACATCAGAACTCATACCGGAGAAAAACCGTTCGC CTGTGACATTTGTGGACGGAAGTTTGCTGACTCCTCTCACAGGACTCGCCA CACTAAGATACACACCGGAAGTCAGAAGCCCTTCCAATGTAGGATATGCA TGAGAAACTTCAGTACGTCATCAAACCGAAAAACGCATATCAGGACACAT ACCGGCGAAAAGCCGTTTGCATGTGATATCTGCGGCAGGAAATTTGCAGCT CAGTGGACACGGGCATGTCACACAAAAATCCATACCGGTAGTCAAAAACC GTTTCAGTGTCGAATCTGCATGAGGAACTTTAGCCGGAAGCAGACGAGAA CCACGCATATAAGAACTCACACAGGTGAGAAACCCTTTGCGTGCGATATCT GCGGTCGCAAATTTGCTCACCGATCCTCCCTGAGGCGACATACTAAATAC ATCTGCGACAGAAAGACGCGGCTCGGGCTCCGGACCGAAAAAAAAGAGA AAGGTAAACGGCGGGGGAGGATCACGGACCCTGGTTACATTTAAGGACGT TTTTGTAGACTTCACGAGGGAGGAATGGAAGCTGTTGGACACCGCCCAGC AAATCGTGTATCGAAATGTAATGTTGGAAAATTATAAAAATCTGGTTTCCC TCGGCTACCAATTGACAAAACCAGACGTCATCCTCAGACTGGAAAAAGGG GAAGAACCTTGGCTTGTCTGA |  |
| 989 | ATGCACGATCAGGAGTTTGACCCCCCTAAGGTGTACCCACCCGTGCCAGCC GAGAAGAGGAAGCCCATCCGCGTGCTGTCCCTGTTCGACGGCATCGCCAC AGGCCTGCTGGTGCTGAAGGATCTGGGCATCCAGGTGGACAGATATATCG CCTCCGAGGTGTGCGAGGATTCTATCACCGTGGGCATGGTGAGGCACCAG GGCAAGATCATGTACGTGGGCGACGTGCGCAGCGTGACACAGAAGCACAT CCAGGAGTGGGGACCCTTCGACCTGGTCATCGGAGGCAGCCCCTGTAATG ACCTGTCCATCGTGAACCCTGCAAGGAAGGGCCTGTATGAGGGAACCGGC AGACTGTTCTTTGAGTTCTACAGGCTGCTGCACGACGCCCGCCCTAAGGAG GGCGATGACAGGCCATTCTTTTGGCTGTTTGAGAACGTGGTGGCCATGGGC GTGAGCGACAAGCGGGATATCTCCAGATTCCTGGAGTCTAATCCCGTGATG ATCGATGCAAAGGAGGTGTCTGCCGCACACAGGGCAAGGTACTTTTGGGG AAATCTGCCTGGCATGAACCGCCCACTGGCCAGCACCGTGAACGACAAGC TGGAGCTGCAGGAGTGCCTGGAGCACGGAAGGATCGCCAAGTTCTCCAAG GTGCGGACAATCACCACAAGATCTAACAGCATCAAGCAGGGCAAGGATCA GCACTTCCCCGTGTTCATGAATGAGAAGGAGGACATCCTGTGGTGTACCGA GATGGAGCGCGTGTTCGGCTTTCCAGTGCACTATACAGACGTGAGCAATAT GAGCCGGCTGGCAAGGCAGAGACTGCTGGGCCGGTCCTGGTCTGTGCCAG TGATCAGACACCTGTTCGCCCCCCTGAAGGAGTACTTTGCCTGCGTGTCTA GCGGCAACTCTAATGCCAACAGCAGAGGCCCTTCCTTTTCCTCTGGCCTGG TGCCACTGTCTCTGAGGGGCAGCCACATGGGCCCCATGGAGATCTACAAG ACCGTGTCCGCCTGGAAGAGGCAGCCTGTGCGCGTGCTGTCTCTGTTCCGC AACATCGACAAGGTGCTGAAGAGCCTGGGCTTTCTGGAGAGCGGATCCGG ATCTGGAGGAGGCACCCTGAAGTATGTGGAGGATGTGACAAATGTGGTGC GGGAGAGATGTGGAGAAGTGGGGCCCCTTCGATCTGGTGTACGGATCCACC CAGCCACTGGGAAGCTCCTGCGATAGGTGTCCAGGATGGTATATGTTCCAG TTTCACAGAATCCTGCAGTACGCACTGCCAAGGCAGGAGAGCCAGCGCCC TTTCTTTTGGATCTTTATGGACAACCTGCTGCTGACAGAGGATGACCAGGA GACAACAACCCGCTTCCTGCAGACAGAGGCAGTGACCCTGCAGGATGTGA GGGGACGCGACTATCAGAATGCCATGCGGGTGTGGTCTAACATCCCTGGC CTGAAGAGCAAGCACGCCCCCCTGACCCCTAAGGAGGAGGAGTACCTGCA GGCCCAGGTGCGGAGCAGATCCAAGCTGGATGCCCCTAAGGTGGACCTGC TGGTGAAGAATTGTCTGCTGCCACTGCGGGAGTACTTCAAGTACTTTAGTC AGAATAGCCTGCCACTGGGTGGACCTAGCTCTGGAGCCCCGCCTCCGTCAG GTGGATCTCCTGCAGGTAGCCCAACTTCCACGGAAGAGGGCACGTCTGAG AGTGCGACTCCTGAGAGCGGGCCTGGCACAAGTACTGAGCCCAGCGAAGG TTCTGCACCCGGGTCTCCAGCTGGGAGCCCTACCTCAACAGAGGAAGGTAC CAGCACAGAGCCTTCTGAGGGTAGCGCTCCTGGCACGTCCACCGAACCGTC CGAGGGGATGGCACCGAAGAAAAAACGCAAAGTTGGTCGAGCCGCCATG GCAGAACGGCCTTTTCAGTGTCGGATCTGCATGAGAAACTTTAGTCAGAGT GCCCATCGCAAGAATCATATTCGAACTCATACCGGTGAAAAACCGTTCGCG TGCGACATCTGTGGTCGAAAGTTTGCCACATCATCCAATAGAAAAACGCAT ACTAAGATTCATACCGGTAGCCAGAAACCATTCCAATGTAGAATCTGCATG CGAAATTTCAGCAGGAGTGACAATTTGTCCGCACATATACGGACACACAC GGGCGAAAAACCCTTTGCTTGCGATATATGCGGTAGAAAGTTCGCTAGGA ACAACGACCGAAAAACACACACGAAGATTCATACAGGTAGTCAGAAGCCA TTTCAATGTCGGATCTGTATGCGAAATTTCTCTACTTCTGGCAGCCTGTCCC GGCACATCAGAACACATACCGGTGAGAAGCCATTTGCATGTGACATATGT GGGAGAAAATTTGCCCAGGCGGGTCACCTTGCGAAGCATACAAAGATCCA CCTCCGCCAGAAGGACGCCGCACGGGCTCCGGACCGAAAAAAAAGAGAA AGGTAAACGGCGGGGGAGGATCACGGACCCTGGTTACATTTAAGGACGTT TTTGTAGACTTCACGAGGGAGGAATGGAAGCTGTTGGACACCGCCCAGCA AATCGTGTATCGAAATGTAATGTTGGAAAATTATAAAAATCTGGTTTCCCT | 3xFLAG- DNMT3AL- XTEN80-SV40 NLS-ZFP-SV40 NLS-KRAB (DNA sequence) |

TABLE E6-continued

DNMT3A/L-eZFP-KRAB fusion proteins

| SEQ ID NOs | Sequence | Description |
|---|---|---|
|  | CGGCTACCAATTGACAAAACCAGACGTCATCCTCAGACTGGAAAAAGGGG<br>AAGAACCTTGGCTTGTCTGA |  |
| 990 | ATGCACGATCAGGAGTTTGACCCCCCTAAGGTGTACCCACCCGTGCCAGCC<br>GAGAAGAGGAAGCCCATCCGCGTGCTGTCCCTGTTCGACGGCATCGCCAC<br>AGGCCTGCTGGTGCTGAAGGATCTGGGCATCCAGGTGGACAGATATATCG<br>CCTCCGAGGTGTGCGAGGATTCTATCACCGTGGGCATGGTGAGGCACCAG<br>GGCAAGATCATGTACGTGGGCGACGTGCGCAGCGTGACACAGAAGCACAT<br>CCAGGAGTGGGGACCCTTCGACCTGGTCATCGGAGGCAGCCCCTGTAATG<br>ACCTGTCCATCGTGAACCCTGCAAGGAAGGGCCTGTATGAGGGAACCGGC<br>AGACTGTTCTTTGAGTTCTACAGGCTGCTGCACGACGCCCGCCCTAAGGAG<br>GGCGATGACAGGCCATTCTTTTGGCTGTTTGAGAACGTGGTGGCCATGGGC<br>GTGAGCGACAAGCGGGATATCTCCAGATTCCTGGAGTCTAATCCCGTGATG<br>ATCGATGCAAAGGAGGTGTCTGCCGCACACAGGGCAAGGTACTTTTGGGG<br>AAATCTGCCTGGCATGAACCGCCCACTGGCCAGCACCGTGAACGACAAGC<br>TGGAGCTGCAGGAGTGCCTGGAGCACGGAAGGATCGCCAAGTTCTCCAAG<br>GTGCGGACAATCACCACAAGATCTAACAGCATCAAGCAGGGCAAGGATCA<br>GCACTTCCCCGTGTTCATGAATGAGAAGGAGGACATCCTGTGGTGTACCGA<br>GATGGAGCGCGTGTTCGGCTTTCCAGTGCACTATACAGACGTGAGCAATAT<br>GAGCCGGCTGGCAAGGCAGAGACTGCTGGGCCGGTCCTGGTCTGTGCCAG<br>TGATCAGACACCTGTTCGCCCCCTGAAGGAGTACTTTGCCTGCGTGTCTA<br>GCGGCAACTCTAATGCCAACAGCAGAGGCCCTTCCTTTTCCTCTGGCCTGG<br>TGCCACTGTCTCTGAGGGGCAGCCACATGGGCCCCATGGAGATCTACAAG<br>ACCGTGTCCGCCTGGAAGAGGCAGCCTGTGCGCGTGCTGTCTCTGTTCCGC<br>AACATCGACAAGGTGCTGAAGAGCCTGGCTTTCTGGAGAGCGGATCCGG<br>ATCTGGAGGAGGCACCCTGAAGTATGTGGAGGATGTGACAAATGTGGTGC<br>GGAGAGATGTGGAGAAGTGGGGCCCCTTCGATCTGGTGTACGGATCCACC<br>CAGCCACTGGGAAGCTCCTGCGATAGGTGTCCAGGATGGTATATGTTCCAG<br>TTTCACAGAATCCTGCAGTACGCACTGCCAAGGCAGGAGAGCCAGCGCCC<br>TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA<br>GGGGACGCGACTATCAGAATGCCATGCGGGTGTGGTCTAACATCCCTGGC<br>CTGAAGAGCAAGCACGCCCCCCTGACCCCTAAGGAGGAGGAGTACCTGCA<br>GGCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC<br>AGAATAGCCTGCCACTGGGTGGACCTAGCTCTGGAGCCCCGCCTCCGTCAG<br>GTGGATCTCCTGCAGGTAGCCCAACTTCCACGGAAGAGGGCACGTCTGAG<br>AGTGCGACTCCTGAGAGCGGGCCTGGCACAAGTACTGAGCCCAGCGAAGG<br>TTCTGCACCCGGGTCTCCAGCTGGGAGCCCTACCTCAACAGAGGAAGGTAC<br>CAGCACAGAGCCTTCTGAGGGTAGCGCTCCTGGCACGTCCACCGAACCGTC<br>CGAGGGGATGGCACCGAAGAAAAACGCAAAGTTGGTCGAGCGGCTATG<br>GCAGAGCGGCCATTCCAATGTAGGATATGTATGAGGAACTTCTCCCGGAG<br>CGATCACCTGTCCCAACACATCCGCACGCATACGGGTGAGAAGCCGTTTGC<br>TTGTGATATCTGCGGAAGAAAATTTGCAGCATCCAGTACACGCACAAAGC<br>ATACGAAGATTCATACGGGATCCCAAAAGCCCTTTCAATGCAGGATTTGTA<br>TGAGGAACTTCAGTCGGTCCGACGATCTGACACGACATATTAGAACTCATA<br>CTGGAGAGAAGCCATTCGCATGTGACATCTGCGGTAGGAAGTTCGCGCAG<br>AAATCTAACCTGTCATCTCACACCAAGATACATACAGGCTCACAGAAGCC<br>GTTTCAATGCCGCATCTGCATGAGGAATTTCAGCCAGTCCGCAAACAGAAC<br>TACGCATATTCGGACGCATACCGGCGAGAAGCCGTTTGCCTGCGACATTTG<br>CGGGAGGAAATTCGCACAGAACGCGACCAGAACCAAACACACCAAAATCC<br>ATCTTAGGCAAAAGGATGCGGCCCGGGCTCCGGACCGAAAAAAAAGAGA<br>AAGGTAAACGGCGGGGAGGATCACGGACCCTGGTTACATTTAAGGACGT<br>TTTTGTAGACTTCACGAGGGAGGAATGGAAGCTGTTGGACACCGCCCAGC<br>AAAATCGTGTATCGAAATGTAATGTTGGAAAATTATAAAAATCTGGTTTCCC<br>TCGGCTACCAATTGACAAAACCAGACGTCATCCTCAGACTGGAAAAAGGG<br>GAAGAACCTTGGCTTGTCTGA | 3xFLAG-<br>DNMT3AL-<br>XTEN80-SV40<br>NLS-ZFP-SV40<br>NLS-KRAB<br>(DNA sequence) |
| 991 | ATGCACGATCAGGAGTTTGACCCCCCTAAGGTGTACCCACCCGTGCCAGCC<br>GAGAAGAGGAAGCCCATCCGCGTGCTGTCCCTGTTCGACGGCATCGCCAC<br>AGGCCTGCTGGTGCTGAAGGATCTGGGCATCCAGGTGGACAGATATATCG<br>CCTCCGAGGTGTGCGAGGATTCTATCACCGTGGGCATGGTGAGGCACCAG<br>GGCAAGATCATGTACGTGGGCGACGTGCGCAGCGTGACACAGAAGCACAT<br>CCAGGAGTGGGGACCCTTCGACCTGGTCATCGGAGGCAGCCCCTGTAATG<br>ACCTGTCCATCGTGAACCCTGCAAGGAAGGGCCTGTATGAGGGAACCGGC<br>AGACTGTTCTTTGAGTTCTACAGGCTGCTGCACGACGCCCGCCCTAAGGAG<br>GGCGATGACAGGCCATTCTTTTGGCTGTTTGAGAACGTGGTGGCCATGGGC<br>GTGAGCGACAAGCGGGATATCTCCAGATTCCTGGAGTCTAATCCCGTGATG<br>ATCGATGCAAAGGAGGTGTCTGCCGCACACAGGGCAAGGTACTTTTGGGG<br>AAATCTGCCTGGCATGAACCGCCCACTGGCCAGCACCGTGAACGACAAGC<br>TGGAGCTGCAGGAGTGCCTGGAGCACGGAAGGATCGCCAAGTTCTCCAAG<br>GTGCGGACAATCACCACAAGATCTAACAGCATCAAGCAGGGCAAGGATCA<br>GCACTTCCCCGTGTTCATGAATGAGAAGGAGGACATCCTGTGGTGTACCGA<br>GATGGAGCGCGTGTTCGGCTTTCCAGTGCACTATACAGACGTGAGCAATAT | 3xFLAG-<br>DNMT3AL-<br>XTEN80-SV40<br>NLS-ZFP-SV40<br>NLS-KRAB<br>(DNA sequence) |

TABLE E6-continued

DNMT3A/L-eZFP-KRAB fusion proteins

| SEQ ID NOs | Sequence | Description |
|---|---|---|
| | GAGCCGGCTGGCAAGGCAGAGACTGCTGGGCCGGTCCTGGTCTGTGCCAG<br>TGATCAGACACCTGTTCGCCCCCCTGAAGGAGTACTTTGCCTGCGTGTCTA<br>GCGGCAACTCTAATGCCAACAGCAGAGGCCCTTCCTTTTCCTCTGGCCTGG<br>TGCCACTGTCTCTGAGGGGCAGCCACATGGGCCCCATGGAGATCTACAAG<br>ACCGTGTCCGCCTGGAAGAGGCAGCCTGTGCGCGTGCTGTCTCTGTTCCGC<br>AACATCGACAAGGTGCTGAAGAGCCTGGGCTTTCTGGAGAGCGGATCCGG<br>ATCTGGAGGAGGCACCCTGAAGTATGTGGAGGATGTGACAAATGTGGTGC<br>GGAGAGATGTGGAGAAGTGGGGCCCCTTCGATCTGGTGTACGGATCCACC<br>CAGCCACTGGGAAGCTCCTGCGATAGGTGTCCAGGATGGTATATGTTCCAG<br>TTTCACAGAATCCTGCAGTACGCACTGCCAAGGCAGGAGAGCCAGCGCCC<br>TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA<br>GGGGACGCGACTATCAGAATGCCATGCGGGTGTGGTCTAACATCCCTGGC<br>CTGAAGAGCAAGCACGCCCCCCTGACCCCTAAGGAGGAGGAGTACCTGCA<br>GGCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC<br>AGAATAGCCTGCCACTGGGTGGACCTAGCTCTGGAGCCCCGCCTCCGTCAG<br>GTGGATCTCCTGCAGGTAGCCCAACTTCCACGGAAGAGGGCACGTCTGAG<br>AGTGCGACTCCTGAGAGCGGGCCTGGCACAAGTACTGAGCCCAGCGAAGG<br>TTCTGCACCCGGGTCTCCAGCTGGGAGCCCTACCTCAACGAGGAAGGTAC<br>CAGCACAGAGCCTTCTGAGGGTAGCGCTCCTGGCACGTCCACCGAACCGTC<br>CGAGGGGATGGCACCGAAGAAAAAACGCAAAGTTGGTCGAGCGGCCATG<br>GCAGAACGACCCTTTCAGTGCCGAATTTGCATGCGGAACTTTAGTCGCAGT<br>GACACCCTGAGCGAGCATATTCGCACGCATACGGGAGAGAAGCCATTTGC<br>ATGCGACATCTGCGGTAGAAAGTTTGCGAGGCGCTGGACGTTGGTAGGCC<br>ACACGAAAATCCATACAGGCTCCCAGAAACCCTTCCAGTGCAGAATTTGTA<br>TGCGCAATTTTAGTGACAGAAGTAACTTGTCCCGACATATAAGGACGCACA<br>CCGGCGAAAAACCGTTTGCCTGTGATATCTGTGGTCGGAAATTCGCCCAGT<br>CCGGTGACTTGACACGGCATACCAAAATACACACTGGAAGCCAAAAGCCT<br>TTTCAGTGTCGCATATGTATGCGCAACTTCAGCCAGAGTAGTGACCTTTCA<br>CGGCATATACGGACGCATACGGGTGAGAAACCCTTCGCCTGTGACATTTGC<br>GGGCGAAAGTTTGCATATCATTGGTACCTGAAAAAACATACGAAAATACA<br>TTTGAGACAAAAAGATGCAGCCCGGGCTCCGGACCGAAAAAAAAGAGAA<br>AGGTAAACGGCGGGGAGGATCACGGACCCTGGTTACATTTAAGGACGTT<br>TTTGTAGACTTCACGAGGGAGGAATGGAAGCTGTTGGACACCGCCCAGCA<br>AATCGTGTATCGAAATGTAATGTTGGAAAATTATAAAAATCTGGTTTCCCT<br>CGGCTACCAATTGACAAAACCAGACGTCATCCTCAGACTGGAAAAAGGGG<br>AAGAACCTTGGCTTGTCTGA | |
| 992 | ATGCACGATCAGGAGTTTGACCCCCCTAAGGTGTACCCACCCGTGCCAGCC<br>GAGAAGAGGAAGCCCATCCGCGTGCTGTCCCTGTTCGACGGCATCGCCAC<br>AGGCCTGCTGGTGCTGAAGGATCTGGGCATCCAGGTGGACAGATATATCG<br>CCTCCGAGGTGTGCGAGGATTCTATCACCGTGGGCATGGTGAGGCACCAG<br>GGCAAGATCATGTACGTGGGCGACGTGCGCAGCGTGGACACAGAAGCACAT<br>CCAGGAGTGGGGACCCTTCGACCTGGTCATCGGAGGCAGCCCCTGTAATG<br>ACCTGTCCATCGTGAACCCTGCAAGGAAGGGCCTGTATGAGGGAACCGGC<br>AGACTGTTCTTTGAGTTCTACAGGCTGCTGCACGACGCCCGCCCTAAGGAG<br>GGCGATGACAGGCCATTCTTTTGGCTGTTTGAGAACGTGGTGGCCATGGC<br>GTGAGCGACAAGCGGGATATCTCCAGATTCCTGGAGTCTAATCCCGTGATG<br>ATCGATGCAAAGGAGGTGTCTGCCGCACACAGGGCAAGGTACTTTTGGGG<br>AAATCTGCCTGGCATGAACCGCCCACTGGCCAGCACCGTGAACGACAAGC<br>TGGAGCTGCAGGAGTGCCTGGAGCACGGAAGGATCGCCAAGTTCTCCAAG<br>GTGCGACAATCACCACAAGATCTAACAGCATCAAGCAGGGCAAGGATCA<br>GCACTTCCCCGTGTTCATGAATGAGAAGGAGGACATCCTGTGGTGTACCGA<br>GATGGAGCGCGTGTTCGGCTTTCCAGTGCACTATACAGACGTGAGCAATAT<br>GAGCCGGCTGGCAAGGCAGAGACTGCTGGGCCGGTCCTGGTCTGTGCCAG<br>TGATCAGACACCTGTTCGCCCCCCTGAAGGAGTACTTTGCCTGCGTGTCTA<br>GCGGCAACTCTAATGCCAACAGCAGAGGCCCTTCCTTTTCCTCTGGCCTGG<br>TGCCACTGTCTCTGAGGGGCAGCCACATGGGCCCCATGGAGATCTACAAG<br>ACCGTGTCCGCCTGGAAGAGGCAGCCTGTGCGCGTGCTGTCTCTGTTCCGC<br>AACATCGACAAGGTGCTGAAGAGCCTGGGCTTTCTGGAGAGCGGATCCGG<br>ATCTGGAGGAGGCACCCTGAAGTATGTGGAGGATGTGACAAATGTGGTGC<br>GGAGAGATGTGGAGAAGTGGGGCCCCTTCGATCTGGTGTACGGATCCACC<br>CAGCCACTGGGAAGCTCCTGCGATAGGTGTCCAGGATGGTATATGTTCCAG<br>TTTCACAGAATCCTGCAGTACGCACTGCCAAGGCAGGAGAGCCAGCGCCC<br>TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA<br>GGGGACGCGACTATCAGAATGCCATGCGGGTGTGGTCTAACATCCCTGGC<br>CTGAAGAGCAAGCACGCCCCCCTGACCCCTAAGGAGGAGGAGTACCTGCA<br>GGCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC<br>AGAATAGCCTGCCACTGGGTGGACCTAGCTCTGGAGCCCCGCCTCCGTCAG<br>GTGGATCTCCTGCAGGTAGCCCAACTTCCACGGAAGAGGGCACGTCTGAG<br>AGTGCGACTCCTGAGAGCGGGCCTGGCACAAGTACTGAGCCCAGCGAAGG | 3xFLAG-<br>DNMT3AL-<br>XTEN80-SV40<br>NLS-ZFP-SV40<br>NLS-KRAB<br>(DNA sequence) |

TABLE E6-continued

DNMT3A/L-eZFP-KRAB fusion proteins

| SEQ ID NOs | Sequence | Description |
|---|---|---|
|  | TTCTGCACCCGGGTCTCCAGCTGGGAGCCCTACCTCAACAGAGGAAGGTAC CAGCACAGAGCCTTCTGAGGGTAGCGCTCCTGGCACGTCCACCGAACCGTC CGAGGGGATGGCACCGAAGAAAAAACGCAAAGTTGGTCGAGCTGCCATGG CCGAGCGCCCGTTTCAATGCAGAATATGTATGAGGAACTTCTCTAGAAGCG CCAATCTTGCGCGACACATTAGAACTCACACAGGCGAGAAACCTTTCGCCT GTGACATCTGCGGCAGAAAATTTGCGCGAAGTGATAACTTGCGCGAGCAC ACAAAAATCCATACCGGTTCCCAAAAGCCCTTTCAATGTAGGATTTGCATG AGGAACTTTTCAAGACCATACACGCTGAGACTCCACATTCGCACGCATACG GGAGAAAACCATTTGCTTGTGACATATGCGGCCGAAAGTTTGCACACCG ATCCAACTTGAATAAGCATACCAAAATCCATACGGGGTCTCAGAAACCCTT CCAGTGTCGGATTTGTATGCGAAACTTCTCTCAGAGTGGTTCTCTTACGCG CCACATTAGAACCCACACGGGGGAAAAGCCATTCGCGTGCGATATCTGTG GCCGGAAATTTGCTACTTCCGCAAATCTTTCTGACATACAAAGATACATC TTAGACAGAAGGATGCGGCACGGGCTCCGGACCGAAAAAAAGAGAAAG GTAAACGGCGGGGGAGGATCACGGACCCTGGTTACATTTAAGGACGTTTTT GTAGACTTCACGAGGGAGGAATGGAAGCTGTTGGACACCGCCCAGCAAAT CGTGTATCGAAATGTAATGTTGGAAAATTATAAAAATCTGGTTTCCCTCGG CTACCAATTGACAAAACCAGACGTCATCCTCAGACTGGAAAAGGGGAAG AACCTTGGCTTGTCTGA |  |
| 993 | ATGCACGATCAGGAGTTTGACCCCCCTAAGGTGTACCCACCCGTGCCAGCC GAGAAGAGGAAGCCCATCCGCGTGCTGTCCCTGTTCGACGGCATCGCCAC AGGCCTGCTGGTGCTGAAGGATCTGGGCATCCAGGTGGACAGATATATCG CCTCCGAGGTGTGCGAGGATTCTATCACCGTGGGCATGGTGAGGCACCAG GGCAAGATCATGTACGTGGGCGACGTGCGCAGCGTGACACAGAAGCACAT CCAGGAGTGGGGACCCTTCGACCTGGTCATCGGAGGCAGCCCCTGTAATG ACCTGTCCATCGTGAACCCTGCAAGGAAGGGCCTGTATGAGGGAACCGGC AGACTGTTCTTTGAGTTCTACAGGCTGCTGCACGACGCCCGCCCTAAGGAG GGCGATGACAGGCCATTCTTTTGGCTGTTTGAGAACGTGGTGGCCATGGGC GTGAGCGACAAGCGGGATATCTCCAGATTCCTGGAGTCTAATCCCGTGATG ATCGATGCAAAGGAGGTGTCTGCCGCACACAGGGCAAGGTACTTTTGGGG AAATCTGCCTGGCATGAACGCCCACTGGCCACCGTGAACGACAAGC TGGAGCTGCAGGAGTGCCTGGAGCACGGAAGGATCGCCAAGTTCTCCAAG GTGCGGACAATCACCACAAGATCTAACAGCATCAAGCAGGGCAAGGATCA GCACTTCCCCGTGTTCATGAATGAGAAGGAGGACATCCTGTGGTGTACCGA GATGGAGCGCGTGTTCGGCTTTCCAGTGCACTATACAGACGTGAGCAATAT GAGCCGGCTGGCAAGGCAGAGACTGCTGGGCCGGTCCTGGTCTGTGCCAG TGATCAGACACCTGTTCGCCCCCCTGAAGGAGTACTTTGCCTGCGTGTCTA GCGGCAACTCTAATGCCAACAGCAGAGGCCCTTCCTTTTTCCTCTGGCCTGG TGCCACTGTCTCTGAGGGGCAGCCACATGGGCCCCATGGAGATCTACAAG ACCGTGTCCGCCTGGAAGAGGCAGCCTGTGCGCGTGCTGTCTCTGTTCCGC AACATCGACAAGGTGCTGAAGAGCCTGGCTTTCTGGAGAGCGGATCCGG ATCTGGAGGAGGCACCCTGAAGTATGTGGAGGATGTGACAAATGTGGTGC GGAGAGATGTGGAGAAGTGGGGCCCCTTCGATCTGGTGTACGGATCCACC CAGCCACTGGGAAGCTCCTGCGATAGGTGTCCAGGATGGTATATGTTCCAG TTTCACAGAATCCTGCAGTACGCACTGCCAAGGCAGGAGAGCCAGCGCCC TTTCTTTTGGATCTTTATGGACAACCTGCTGCTGACAGAGGATGACCAGGA GACAACAACCCGCTTCCTGCAGACAGAGGCAGTGACCCTGCAGGATGTGA GGGGACGCGACTATCAGAATGCCATGCGGGTGTGGTCTAACATCCCTGGC CTGAAGAGCAAGCACGCCCCCCTGACCCCTAAGGAGGAGGAGTACCTGCA GGCCCAGGTGCGGAGCAGATCCAAGCTGGATGCCCCTAAGGTGGACCTGC TGGTGAAGAATTGTCTGCTGCCACTGCGGGAGTACTTCAAGTACTTTAGTC AGAATAGCCTGCCACTGGGTGGACCTAGCTCTGGAGCCCCGCCTCCGTCAG GTGGATCTCCTGCAGGTAGCCCAACTTCCACGGAAGAGGGCACGTCTGAG AGTGCGACTCCTGAGAGCGGGCCTGGCACAAGTACTGAGCCCAGCGAAGG TTCTGCACCCGGGTCTCCAGCTGGGAGCCCTACCTCAACAGAGGAAGGTAC CAGCACAGAGCCTTCTGAGGGTAGCGCTCCTGGCACGTCCACCGAACCGTC CGAGGGGATGGCACCGAAGAAAAAACGCAAAGTTGGTCGATTGGAGCCCG GTGAAAAACCATATGCCTGTCCAGAGTGTGGAAAAAGTTTTAGCAGAAGC GACGACCTGGTTAGGCATCAACGAACTCACACAGGGGAAAGCCGTACAA ATGTCCTGAATGCGGAAAGTCATTCTCCACTTCAGGTAGCCTCGTGCGACA TCAGCGCACACATACTGGCGAAAAACCTTATAAGTGTCCGGAATGCGGCA AGAGTTTTTCTAGAAGTGATAAGCTCGTGCGACACCAGCGGACGCACACG GGTGAGAAGCCCTACGCCTGCCCAGAGTGCGGAAAGTCCTTTAGTAGGTCT GACGAACTGGTCCGGCACCAACGAACCCATACAGGGGAGAAACCCTACAA ATGTCCAGAGTGCGGGAAATCATTTTCAACGTCTCACAGCTTGACGGAACA TCAGAGGACCCATACAGGCGAAAAGCCTTACAAATGTCCGGAGTGCGGAA AGTCTTTCAGCCGGGCTGATAATCTCACGGAGCACCAAAGAACCCACACG GTAAGAAAACCTGCTCCGGACCGAAAAAAAGAGAAAGGTAAACGG CGGGGGAGGATCACGGACCCTGGTTACATTTAAGGACGTTTTTGTAGACTT CACGAGGGAGGAATGGAAGCTGTTGGACACCGCCCAGCAAATCGTGTATC GAAATGTAATGTTGGAAAATTATAAAAATCTGGTTTCCCTCGGCTACCAAT TGACAAAACCAGACGTCATCCTCAGACTGGAAAAGGGGAAGAACCTTGG CTTGTCTGA | 3xFLAG-DNMT3AL-XTEN80-SV40 NLS-ZFP-SV40 NLS-KRAB (DNA sequence) |

TABLE E6-continued

DNMT3A/L-eZFP-KRAB fusion proteins

| SEQ ID NOs | Sequence | Description |
|---|---|---|
| 994 | ATGCACGATCAGGAGTTTGACCCCCCTAAGGTGTACCCACCCGTGCCAGCC<br>GAGAAGAGGAAGCCCATCCGCGTGCTGTCCCTGTTCGACGGCATCGCCAC<br>AGGCCTGCTGGTGCTGAAGGATCTGGGCATCCAGGTGGACAGATATATCG<br>CCTCCGAGGTGTGCGAGGATTCTATCACCGTGGGCATGGTGAGGCACCAG<br>GGCAAGATCATGTACGTGGGCGACGTGCGCAGCGTGACACAGAAGCACAT<br>CCAGGAGTGGGGACCCTTCGACCTGGTCATCGGAGGCAGCCCCTGTAATG<br>ACCTGTCCATCGTGAACCCTGCAAGGAAGGGCCTGTATGAGGGAACCGGC<br>AGACTGTTCTTTGAGTTCTACAGGCTGCTGCACGACGCCCGCCCTAAGGAG<br>GGCGATGACAGGCCATTCTTTTGGCTGTTTGAGAACGTGGTGGCCATGGGC<br>GTGAGCGACAAGCGGGATATCTCCAGATTCCTGGAGTCTAATCCCGTGATG<br>ATCGATGCAAAGGAGGTGTCTGCCGCACACAGGGCAAGGTACTTTTGGGG<br>AAATCTGCCTGGCATGAACCGCCCACTGGCCAGCACCGTGAACGACAAGC<br>TGGAGCTGCAGGAGTGCCTGGAGCACGGAAGGATCGCCAAGTTCTCCAAG<br>GTGCGGACAATCACCACAAGATCTAACAGCATCAAGCAGGGCAAGGATCA<br>GCACTTCCCCGTGTTCATGAATGAGAAGGAGGACATCCTGTGGTGTACCGA<br>GATGGAGCGCGTGTTCGGCTTTCCAGTGCACTATACAGACGTGAGCAATAT<br>GAGCCGGCTGGCAAGGCAGAGACTGCTGGGCCGGTCCTGGTCTGTGCCAG<br>TGATCAGACACCTGTTCGCCCCCCTGAAGGAGTACTTTGCCTGCGTGTCTA<br>GCGGCAACTCTAATGCCAACAGCAGAGGCCCTTCCTTTTCCTCTGGCCTGG<br>TGCCACTGTCTCTGAGGGGCAGCCACATGGGCCCCATGGAGATCTACAAG<br>ACCGTGTCCGCCTGGAAGAGGCAGCCTGTGCGCGTGCTGTCTCTGTTCCGC<br>AACATCGACAAGGTGCTGAAGAGCCTGGGCTTTCTGGAGAGCGGATCCGG<br>ATCTGGAGGAGGCACCCTGAAGTATGTGGAGGATGTGACAAATGTGGTGC<br>GGAGAGATGTGGAGAAGTGGGGCCCCTTCGATCTGGTGTACGGATCCACC<br>CAGCCACTGGGAAGCTCCTGCGATAGGTGTCCAGGATGGTATATGTTCCAG<br>TTTCACAGAATCCTGCAGTACGCACTGCCAAGGCAGGAGAGCCAGCGCCC<br>TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA<br>GGGGACGCGACTATCAGAATGCCATGCGGGTGTGGTCTAACATCCCTGGC<br>CTGAAGAGCAAGCACGCCCCCCTGACCCCTAAGGAGGAGGAGTACCTGCA<br>GGCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC<br>AGAATAGCCTGCCACTGGGTGGACCTAGCTCTGGAGCCCCGCCTCCGTCAG<br>GTGGATCTCCTGCAGGTAGCCCAACTTCCACGGAAGAGGGCACGTCTGAG<br>AGTGCGACTCCTGAGAGCGGGCCTGGCACAAGTACTGAGCCCAGCGAAGG<br>TTCTGCACCCGGGTCTCCAGCTGGGAGCCCTACCTCAACAGAGGAAGGTAC<br>CAGCACAGAGCCTTCTGAGGGTAGCGCTCCTGGCACGTCCACCGAACCGTC<br>CGAGGGGATGGCACCGAAGAAAAACGCAAAGTTGGTCGATTGGAGCCG<br>GGAGAAAAGCCATATGCCTGTCCGGAATGCGGCAAAAGCTTTTCAGAACG<br>GTCCCATTTGCGGGAACATCAGCGCACCCATACCGGAGAAAAGCCTTACA<br>AGTGTCCCGAGTGTGGTAAGAGCTTTTCAACTTCCCACAGTCTCACTGAAC<br>ATCAGCGAACTCACACAGGCGAAAAACCATACAAATGCCCGGAGTGTGGA<br>AAGAGTTTTTCTCAAGCTGGGCACTTGGCCAGCCACCAAAGGACTCATACG<br>GGCGAGAAACCGTATGCCTGTCCAGAATGCGGGAAATCATTTTCTACTAGT<br>CATTCCCTTACGGAACATCAGAGAACGCACACCGGGGAGAAGCCATACAA<br>GTGTCCGGAGTGCGGAAAATCATTCTCCGACCCGGGTCATCTCGTTCGCCA<br>TCAGAGGACTCATACTGGAGAGAAACCGTATAAATGTCCTGAATGCGGGA<br>AGAGCTTTTCTACATCTGGGAACCTTGTGCGGCACCAGCGAACCCACACGG<br>GGAAAAAGACTTCTGCTCCGGACCGAAAAAAAAGAGAAAGGTAAACGGC<br>GGGGGAGGATCACGGACCCTGGTTACATTTAAGGACGTTTTTGTAGACTTC<br>ACGAGGGAGGAATGGAAGCTGTTGGACACCGCCCAGCAAATCGTGTATCG<br>AAATGTAATGTTGGAAAATTATAAAAATCTGGTTTCCCTCGGCTACCAATT<br>GACAAAACCAGACGTCATCCTCAGACTGGAAAAAGGGGAAGAACCTTGGC<br>TTGTCTGA | 3xFLAG-<br>DNMT3AL-<br>XTEN80-SV40<br>NLS-ZFP-SV40<br>NLS-KRAB<br>(DNA sequence) |
| 995 | ATGCACGATCAGGAGTTTGACCCCCCTAAGGTGTACCCACCCGTGCCAGCC<br>GAGAAGAGGAAGCCCATCCGCGTGCTGTCCCTGTTCGACGGCATCGCCAC<br>AGGCCTGCTGGTGCTGAAGGATCTGGGCATCCAGGTGGACAGATATATCG<br>CCTCCGAGGTGTGCGAGGATTCTATCACCGTGGGCATGGTGAGGCACCAG<br>GGCAAGATCATGTACGTGGGCGACGTGCGCAGCGTGACACAGAAGCACAT<br>CCAGGAGTGGGGACCCTTCGACCTGGTCATCGGAGGCAGCCCCTGTAATG<br>ACCTGTCCATCGTGAACCCTGCAAGGAAGGGCCTGTATGAGGGAACCGGC<br>AGACTGTTCTTTGAGTTCTACAGGCTGCTGCACGACGCCCGCCCTAAGGAG<br>GGCGATGACAGGCCATTCTTTTGGCTGTTTGAGAACGTGGTGGCCATGGGC<br>GTGAGCGACAAGCGGGATATCTCCAGATTCCTGGAGTCTAATCCCGTGATG<br>ATCGATGCAAAGGAGGTGTCTGCCGCACACAGGGCAAGGTACTTTTGGGG<br>AAATCTGCCTGGCATGAACCGCCCACTGGCCAGCACCGTGAACGACAAGC<br>TGGAGCTGCAGGAGTGCCTGGAGCACGGAAGGATCGCCAAGTTCTCCAAG<br>GTGCGGACAATCACCACAAGATCTAACAGCATCAAGCAGGGCAAGGATCA<br>GCACTTCCCCGTGTTCATGAATGAGAAGGAGGACATCCTGTGGTGTACCGA<br>GATGGAGCGCGTGTTCGGCTTTCCAGTGCACTATACAGACGTGAGCAATAT<br>GAGCCGGCTGGCAAGGCAGAGACTGCTGGGCCGGTCCTGGTCTGTGCCAG<br>TGATCAGACACCTGTTCGCCCCCCTGAAGGAGTACTTTGCCTGCGTGTCTA | 3xFLAG-<br>DNMT3AL-<br>XTEN80-SV40<br>NLS-ZFP-SV40<br>NLS-KRAB<br>(DNA sequence) |

TABLE E6-continued

DNMT3A/L-eZFP-KRAB fusion proteins

| SEQ ID NOs | Sequence | Description |
|---|---|---|
|  | GCGGCAACTCTAATGCCAACAGCAGAGGCCCTTCCTTTTCCTCTGGCCTGG<br>TGCCACTGTCTCTGAGGGGCAGCCACATGGGCCCCATGGAGATCTACAAG<br>ACCGTGTCCGCCTGGAAGAGGCAGCCTGTGCGCGTGCTGTCTCTGTTCCGC<br>AACATCGACAAGGTGCTGAAGAGCCTGGCTTTCTGGAGAGCGGATCCGG<br>ATCTGGAGGAGGCACCCTGAAGTATGTGGAGGATGTGACAAATGTGGTGC<br>GGAGAGATGTGGAGAAGTGGGGCCCCTTCGATCTGGTGTACGGATCCACC<br>CAGCCACTGGGAAGCTCCTGCGATAGGTGTCCAGGATGGTATATGTTCCAG<br>TTTCACAGAATCCTGCAGTACGCACTGCCAAGGCAGGAGAGCCAGCGCCC<br>TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA<br>GGGGACGCGACTATCAGAATGCCATGCGGGTGTGGTCTAACATCCCTGGC<br>CTGAAGAGCAAGCACGCCCCCTGACCCCTAAGGAGGAGGAGTACCTGCA<br>GGCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC<br>AGAATAGCCTGCCACTGGGTGGACCTAGCTCTGGAGCCCCGCCTCCGTCAG<br>GTGGATCTCCTGCAGGTAGCCCAACTTCCACGGAAGAGGGCACGTCTGAG<br>AGTGCGACTCCTGAGAGCGGGCCTGGCACAAGTACTGAGCCCAGCGAAGG<br>TTCTGCACCCGGGTCTCCAGCTGGGAGCCCTACCTCAACAGAGGAAGGTAC<br>CAGCACAGAGCCTTCTGAGGGTAGCGCTCCTGGCACGTCCACCGAACCGTC<br>CGAGGGGATGGCACCGAAGAAAAACGCAAAGTTGGTCGACTGGAACCG<br>GGTGAAAAACCCTACGCTTGTCCCGAGTGTGGGAAATCATTCTCAAGGGC<br>AGATAATCTTACGGAACATCAGCGCACACACACCGGGGAAAAACCCTATA<br>AGTGCCCTGAGTGTGGTAAATCATTCTCTACGTCAGGGTCATTGGTGCGCC<br>ATCAGAGGACCCATACAGGCGAAAAACCGTATAAGTGCCCCGAATGCGGT<br>AAAAGCTTCAGCAGAAAAGATAACTTGAAAAATCACCAACGCACTCACAC<br>GGGAGAAAAACCGTACGCATGCCCGGAGTGCGGCAAGAGTTTCAGTCAGA<br>GTAGCTCACTTGTTCGCCACCAAAGAACCCACACAGGCGAAAAGCCCTAC<br>AAGTGTCCTGAATGTGGAAAGAGTTTCAGTCGAAGTGATAAATTGGTTAG<br>CACCAAAGAACACACACTGGAGAGAAACCGTACAAGTGTCCAGAATGTG<br>GCAAGTCTTTTTCTGATTCTGGAAATTTGCGCGTCCATCAAAGGACTCATA<br>CTGGGAAAAAGACGTCCGCTCCGGACCGAAAAAAAAGAGAAAGGTAAAC<br>GGCGGGGGAGGATCACGACCCTGGTTACATTTAAGGACGTTTTTGTAGAC<br>TTCACGAGGGAGGAATGGAAGCTGTTGGACACCGCCCAGCAAATCGTGTA<br>TCGAAATGTAATGTTGGAAAATTATAAAAATCTGGTTTCCCTCGGCTACCA<br>ATTGACAAAACCAGACGTCATCCTCAGACTGGAAAAAGGGGAAGAACCTT<br>GGCTTGTCTGA |  |
| 996 | ATGCACGATCAGGAGTTTGACCCCCCTAAGGTGTACCCACCCGTGCCAGCC<br>GAGAAGAGGAAGCCCATCCGCGTGCTGTCCCTGTTCGACGGCATCGCCAC<br>AGGCCTGCTGGTGCTGAAGGATCTGGGCATCCAGGTGGACAGATATATCG<br>CCTCCGAGGTGTGCGAGGATTCTATCACCGTGGGCATGGTGAGGCACCAG<br>GGCAAGATCATGTACGTGGGCGACGTGCGCAGCGTGACACAGAAGCACAT<br>CCAGGAGTGGGGACCCTTCGACCTGGTCATCGGAGGCAGCCCCTGTAATG<br>ACCTGTCCATCGTGAACCCTGCAAGGAAGGGCCTGTATGAGGGAACCGGC<br>AGACTGTTCTTTGAGTTCTACAGGCTGCTGCACGACGCCCGCCCTAAGGAG<br>GGCGATGACAGGCCATTCTTTTGGCTGTTTGAGAACGTGGTGGCCATGGGC<br>GTGAGCGACAAGCGGGATATCTCCAGATTCCTGGAGTCTAATCCCGTGATG<br>ATCGATGCAAAGGAGGTGTCTGCCGCACACAGGGCAAGGTACTTTTGGGG<br>AAATCTGCCTGGCATGAACCGCCCACTGGCCAGCACCGTGAACGACAAGC<br>TGGAGCTGCAGGAGTGCCTGGAGCACGGAAGGATCGCCAAGTTCTCCAAG<br>GTGCGGACAATCACCACAAGATCTAACAGCATCAAGCAGGGCAAGGATCA<br>GCACTTCCCCGTGTTCATGAATGAGAAGGAGGACATCCTGTGGTGTACCGA<br>GATGGAGCGCGTGTTCGGCTTTCCAGTGCACTATACAGACGTGAGCAATAT<br>GAGCCGGCTGGCAAGGCAGAGACTGCTGGGCCGGTCCTGGTCTGTGCCAG<br>TGATCAGACACCTGTTCGCCCCCCTGAAGGAGTACTTTGCCTGCGTGTCTA<br>GCGGCAACTCTAATGCCAACAGCAGAGGCCCTTCCTTTTCCTCTGGCCTGG<br>TGCCACTGTCTCTGAGGGGCAGCCACATGGGCCCCATGGAGATCTACAAG<br>ACCGTGTCCGCCTGGAAGAGGCAGCCTGTGCGCGTGCTGTCTCTGTTCCGC<br>AACATCGACAAGGTGCTGAAGAGCCTGGCTTTCTGGAGAGCGGATCCGG<br>ATCTGGAGGAGGCACCCTGAAGTATGTGGAGGATGTGACAAATGTGGTGC<br>GGAGAGATGTGGAGAAGTGGGGCCCCTTCGATCTGGTGTACGGATCCACC<br>CAGCCACTGGGAAGCTCCTGCGATAGGTGTCCAGGATGGTATATGTTCCAG<br>TTTCACAGAATCCTGCAGTACGCACTGCCAAGGCAGGAGAGCCAGCGCCC<br>TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA<br>GGGGACGCGACTATCAGAATGCCATGCGGGTGTGGTCTAACATCCCTGGC<br>CTGAAGAGCAAGCACGCCCCCTGACCCCTAAGGAGGAGGAGTACCTGCA<br>GGCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC<br>AGAATAGCCTGCCACTGGGTGGACCTAGCTCTGGAGCCCCGCCTCCGTCAG<br>GTGGATCTCCTGCAGGTAGCCCAACTTCCACGGAAGAGGGCACGTCTGAG<br>AGTGCGACTCCTGAGAGCGGGCCTGGCACAAGTACTGAGCCCAGCGAAGG<br>TTCTGCACCCGGGTCTCCAGCTGGGAGCCCTACCTCAACAGAGGAAGGTAC<br>CAGCACAGAGCCTTCTGAGGGTAGCGCTCCTGGCACGTCCACCGAACCGTC | 3xFLAG-<br>DNMT3AL-<br>XTEN80-SV40<br>NLS-ZFP-SV40<br>NLS-KRAB<br>(DNA sequence) |

TABLE E6-continued

DNMT3A/L-eZFP-KRAB fusion proteins

| SEQ ID NOs | Sequence | Description |
|---|---|---|
| | CGAGGGGATGGCACCGAAGAAAAAACGCAAAGTTGGTCGACTCGAACCA GGGGAAAAGCCATACGCTTGCCCCGAGTGTGGAAAATCTTTCTCTCAGTCA AGCTCCCTTGTCAGACACCAGAGAACCCATACGGGTGAGAAACCATACAA GTGCCCAGAGTGCGGCAAAAGCTTCAGTCAGAGTGGCGATCTGCGCCGGC ATCAAAGAACTCACACTGGAGAAAAGCCCTATAAGTGCCCCGAATGTGGA AAGAGTTTTTCCAGGAGTGACGAAAGAAAGAGACACCAGCGGACTCACAC CGGCGAGAAACCATACGCATGCCCCGAGTGCGGAAAAAGTTTTTCCCACC GCACAACCCTTACCAATCATCAACGCACGCACACAGGGGAGAAACCCTAC AAGTGCCCGGAGTGTGGCAAGTCATTCAGCCGAAGTGACCACCTCACTAA CCACCAAAGGACTCACACAGGAGAAAAACCCTACAAATGTCCGGAGTGCG GAAAATCTTTTTCCACGTCCGGTGAGCTGGTCCGCCATCAACGAACCCATA CTGGTAAAAAAACTAGCGCTCCGGACCGAAAAAAAAGAGAAAGGTAAAC GGCGGGGGAGGATCACGGACCCTGGTTACATTTAAGGACGTTTTTGTAGAC TTCACGAGGGAGGAATGGAAGCTGTTGGACACCGCCCAGCAAATCGTGTA TCGAAATGTAATGTTGGAAAATTATAAAAATCTGGTTTCCCTCGGCTACCA ATTGACAAAACCAGACGTCATCCTCAGACTGGAAAAAGGGGAAGAACCTT GGCTTGTCTGA | |
| 997 | ATGCACGATCAGGAGTTTGACCCCCCTAAGGTGTACCCACCCGTGCCAGCC GAGAAGAGGAAGCCCATCCGCGTGCTGTCCCTGTTCGACGGCATCGCCAC AGGCCTGCTGGTGCTGAAGGATCTGGGCATCCAGGTGGACAGATATATCG CCTCCGAGGTGTGCGAGGATTCTATCACCGTGGGCATGGTGAGGCACCAG GGCAAGATCATGTACGTGGGCGACGTGCGCAGCGTGACACAGAAGCACAT CCAGGAGTGGGGACCCTTCGACCTGGTCATCGGAGGCAGCCCCTGTAATG ACCTGTCCATCGTGAACCCTGCAAGGAAGGGCCTGTATGAGGGAACCGGC AGACTGTTCTTTGAGTTCTACAGGCTGCTGCACGACGCCCGCCCTAAGGAG GGCGATGACAGGCCATTCTTTTGGCTGTTTGAGAACGTGGTGGCCATGGGC GTGAGCGACAAGCGGGATATCTCCAGATTCCTGGAGTCTAATCCCGTGATG ATCGATGCAAAGGAGGTGTCTGCCGCACACAGGGCAAGGTACTTTTGGGG AAATCTGCCTGGCATGAACCGCCCACTGGCCAGCACCGTGAACGACAAGC TGGAGCTGCAGGAGTGCCTGGAGCACGGAAGGATCGCCAAGTTCTCCAAG GTGCGGACAATCACCACAAGATCTAACAGCATCAAGCAGGGCAAGGATCA GCACTTCCCCGTGTTCATGAATGAGAAGGAGGACATCCTGTGGTGTACCGA GATGGAGCGCGTGTTCGGCTTTCCAGTGCACTATACAGACGTGAGCAATAT GAGCCGGCTGGCAAGGCAGAGACTGCTGGGCCGGTCCTGGTCTGTGCCAG TGATCAGACACCTGTTCGCCCCCCTGAAGGAGTACTTTGCCTGCGTGTCTA GCGGCAACTCTAATGCCAACAGCAGAGGCCCTTCCTTTTCCTCTGGCCTGG TGCCACTGTCTCTGAGGGGCAGCCACATGGGCCCCATGGAGATCTACAAG ACCGTGTCCGCCTGGAAGAGGCAGCCTGTGCGCGTGCTGTCTCTGTTCCGC AACATCGACAAGGTGCTGAAGAGCCTGGGCTTTCTGGAGAGCGGATCCGG ATCTGGAGGAGGCACCCTGAAGTATGTGGAGGATGTGACAAATGTGGTGC GGAGAGATGTGGAGAAGTGGGGCCCCTTCGATCTGGTGTACGGATCCACC CAGCCACTGGGAAGCTCCTGCGATAGGTGTCCAGGATGGTATATGTTCCAG TTTCACAGAATCCTGCAGTACGCACTGCCAAGGCAGGAGAGCCAGCGCCC TTTCTTTTGGATCTTTATGGACAACCTGCTGCTGACAGAGGATGACCAGGA GACAACAACCCGCTTCCTGCAGACAGAGGCAGTGACCCTGCAGGATGTGA GGGGACGCGACTATCAGAATGCCATGCGGGTGTGGTCTAACATCCCTGGC CTGAAGAGCAAGCACGCCCCCCTGACCCCTAAGGAGGAGGAGTACCTGCA GGCCCAGGTGCGGAGCAGATCCAAGCTGGATGCCCCTAAGGTGGACCTGC TGGTGAAGAATTGTCTGCTGCCACTGCGGGAGTACTTCAAGTACTTTAGTC AGAATAGCCTGCCACTGGGTGGACCTAGCTCTGGAGCCCCGCCTCCGTCAG GTGGATCTCCTGCAGGTAGCCCAACTTCCACGGAAGAGGGCACGTCTGAG AGTGCGACTCCTGAGAGCGGGCCTGGCACAAGTACTGAGCCCAGCGAAGG TTCTGCACCCGGGTCTCCAGCTGGGAGCCCTACCTCAACAGAGGAAGGTAC CAGCACAGAGCCTTCTGAGGGTAGCGCTCCTGGCACGTCCACCGAACCGTC CGAGGGGATGGCACCGAAGAAAAAACGCAAAGTTGGTCGACTGGAACCC GGGGAGAAGCCGTACGCTTGCCCAGAGTGCGGAAAAGAGCTTCTCTCAGAG CGGAGACCTTAGACGCCACCAGCGAACCCACACCGGCGAAAAACCGTATA AATGCCCGGAATGCGGCAAGAGTTTTAGTCGGTCCGATGAGCGAAAGAGG CATCAACGAACCCATACGGGAGAGAAACCCTACAAGTGCCCTGAGTGTGG TAAGTCATTTTCCCACAGAACGACGTTGACGAATCACCAGGAACCCATAC GGGTGAGAAACCTTACGCTTGCCCGGAGTGCGGCAAAAGCTTCAGCCGGA GTGATCACTTGACCAATCATCAGAGGACACACACGGGTGAGAAGCCCTAC AAATGTCCGAATGCGGCAAGTCTTTCTCAACGTCAGGCGAACTCGTCCGG CACCAGCGAACACATACGGGAGAAAGCCGTACAAATGTCCGGAATGCGG AAAGTCATTTTCACGGTCAGATGACTTGGTGCGACACCAGCGACTCACAC AGGCAAGAAGACCTCAGCTCCGGACCGAAAAAAAAGAGAAAGGTAAACG GCGGGGAGGATCACGGACCCTGGTTACATTTAAGGACGTTTTTGTAGACT TCACGAGGGAGGAATGGAAGCTGTTGGACACCGCCCAGCAAATCGTGTAT CGAAATGTAATGTTGGAAAATTATAAAAATCTGGTTTCCCTCGGCTACCAA TTGACAAAACCAGACGTCATCCTCAGACTGGAAAAAGGGGAAGAACCTTG GCTTGTCTGA | 3xFLAG-DNMT3AL-XTEN80-SV40 NLS-ZFP-SV40 NLS-KRAB (DNA sequence) |

TABLE E6-continued

DNMT3A/L-eZFP-KRAB fusion proteins

| SEQ ID NOs | Sequence | Description |
|---|---|---|
| 998 | ATGCACGATCAGGAGTTTGACCCCCCTAAGGTGTACCCACCCGTGCCAGCC<br>GAGAAGAGGAAGCCCATCCGCGTGCTGTCCCTGTTCGACGGCATCGCCAC<br>AGGCCTGCTGGTGCTGAAGGATCTGGGCATCCAGGTGGACAGATATATCG<br>CCTCCGAGGTGTGCGAGGATTCTATCACCGTGGGCATGGTGAGGCACCAG<br>GGCAAGATCATGTACGTGGGCGACGTGCGCAGCGTGACACAGAAGCACAT<br>CCAGGAGTGGGGACCCTTCGACCTGGTCATCGGAGGCAGCCCCTGTAATG<br>ACCTGTCCATCGTGAACCCTGCAAGGAAGGGCCTGTATGAGGGAACCGGC<br>AGACTGTTCTTTGAGTTCTACAGGCTGCTGCACGACGCCCGCCCTAAGGAG<br>GGCGATGACAGGCCATTCTTTTGGCTGTTTGAGAACGTGGTGGCCATGGGC<br>GTGAGCGACAAGCGGGATATCTCCAGATTCCTGGAGTCTAATCCCGTGATG<br>ATCGATGCAAAGGAGGTGTCTGCCGCACACAGGGCAAGGTACTTTTGGGG<br>AAATCTGCCTGGCATGAACCGCCCACTGGCCAGCACCGTGAACGACAAGC<br>TGGAGCTGCAGGAGTGCCTGGAGCACGGAAGGATCGCCAAGTTCTCCAAG<br>GTGCGGACAATCACCACAAGATCTAACAGCATCAAGCAGGGCAAGGATCA<br>GCACTTCCCCGTGTTCATGAATGAGAAGGAGGACATCCTGTGGTGTACCGA<br>GATGGAGCGCGTGTTCGGCTTTCCAGTGCACTATACAGACGTGAGCAATAT<br>GAGCCGGCTGGCAAGGCAGAGACTGCTGGGCCGGTCCTGGTCTGTGCCAG<br>TGATCAGACACCTGTTCGCCCCCCTGAAGGAGTACTTTGCCTGCGTGTCTA<br>GCGGCAACTCTAATGCCAACAGCAGAGGCCCTTCCTTTTCCTCTGGCCTGG<br>TGCCACTGTCTCTGAGGGGCAGCCACATGGGCCCCATGGAGATCTACAAG<br>ACCGTGTCCGCCTGGAAGAGGCAGCCTGTGCGCGTGCTGTCTCTGTTCCGC<br>AACATCGACAAGGTGCTGAAGAGCCTGGGCTTTCTGGAGAGCGGATCCGG<br>ATCTGGAGGAGGCACCCTGAAGTATGTGGAGGATGTGACAAATGTGGTGC<br>GGAGAGATGTGGAGAAGTGGGGCCCCTTCGATCTGGTGTACGGATCCACC<br>CAGCCACTGGGAAGCTCCTGCGATAGGTGTCCAGGATGGTATATGTTCCAG<br>TTTCACAGAATCCTGCAGTACGCACTGCCAAGGCAGGAGAGCCAGCGCCC<br>TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA<br>GGGGACGCGACTATCAGAATGCCATGCGGGTGTGGTCTAACATCCCTGGC<br>CTGAAGAGCAAGCACGCCCCCCTGACCCCTAAGGAGGAGGAGTACCTGCA<br>GGCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC<br>AGAATAGCCTGCCACTGGGTGGACCTAGCTCTGGAGCCCCGCCTCCGTCAG<br>GTGGATCTCCTGCAGGTAGCCCAACTTCCACGGAAGAGGGCACGTCTGAG<br>AGTGCGACTCCTGAGAGCGGGCCTGGCACAAGTACTGAGCCTCAGCGAAGG<br>TTCTGCACCCGGGTCTCCAGCTGGGAGCCCTACCTCAACAGAGGAAGGTAC<br>CAGCACAGAGCCTTCTGAGGGTAGCGCTCCTGGCACGTCCACCGAACCGTC<br>CGAGGGGATGGCACCGAAGAAAAAACGCAAAGTTGGTCGACTGGAGCCTG<br>GTGAGAAGCCGTATGCATGTCCTGAGTGTGGGAAGTCATTTAGTCAGAGG<br>GCCCACTTGGAACGACACCAAAGGACCCACACTGGTGAAAAACCCTACAA<br>ATGCCCAGAGTGTGGTAAGTCTTTTTCACAGCTGGCCCACCTGAGAGCACA<br>CCAGCGAACTCATACGGGCGAGAAACCATACAAGTGTCCAGAGTGCGGAA<br>AGTCATTCTCAGATCCCGGCCACTTGGTGCGACATCAGAGAACGCACACA<br>GGGGAGAAGCCTTATGCTTGCCCGGAATGCGGGAAGTCTTTCAGCCGCCG<br>AAGTGCTTGTCGAAGGCACCAACGGACCCATACCGGTGAGAAACCATATA<br>AGTGCCCAGAGTGTGGAAAGAGTTTTAGTCGATCCGATCACCTGACTACGC<br>ACCAGCGGACGCACACAGGAGAGAAACCGTATAAGTGCCCTGAATGCGGT<br>AAGAGCTTCTCTCAATCAAGCTCACTGGTTAGGCACCAACGCACTCATACC<br>GGCAAGAAGACGTCAGCTCCGGACCGAAAAAAAAGAGAAAGGTAAACGG<br>CGGGGGAGGATCACGGACCCTGGTTACATTTAAGGACGTTTTTGTAGACTT<br>CACGAGGGAGGAATGGAAGCTGTTGGACACCGCCCAGCAAATCGTGTATC<br>GAAATGTAATGTTGGAAAATTATAAAAATCTGGTTTCCCTCGGCTACCAAT<br>TGACAAAACCAGACGTCATCCTCAGACTGGAAAAAGGGGAAGAACCTTGG<br>CTTGTCTGA | 3xFLAG-<br>DNMT3AL-<br>XTEN80-SV40<br>NLS-ZFP-SV40<br>NLS-KRAB<br>(DNA sequence) |
| 999 | ATGCACGATCAGGAGTTTGACCCCCCTAAGGTGTACCCACCCGTGCCAGCC<br>GAGAAGAGGAAGCCCATCCGCGTGCTGTCCCTGTTCGACGGCATCGCCAC<br>AGGCCTGCTGGTGCTGAAGGATCTGGGCATCCAGGTGGACAGATATATCG<br>CCTCCGAGGTGTGCGAGGATTCTATCACCGTGGGCATGGTGAGGCACCAG<br>GGCAAGATCATGTACGTGGGCGACGTGCGCAGCGTGACACAGAAGCACAT<br>CCAGGAGTGGGGACCCTTCGACCTGGTCATCGGAGGCAGCCCCTGTAATG<br>ACCTGTCCATCGTGAACCCTGCAAGGAAGGGCCTGTATGAGGGAACCGGC<br>AGACTGTTCTTTGAGTTCTACAGGCTGCTGCACGACGCCCGCCCTAAGGAG<br>GGCGATGACAGGCCATTCTTTTGGCTGTTTGAGAACGTGGTGGCCATGGGC<br>GTGAGCGACAAGCGGGATATCTCCAGATTCCTGGAGTCTAATCCCGTGATG<br>ATCGATGCAAAGGAGGTGTCTGCCGCACACAGGGCAAGGTACTTTTGGGG<br>AAATCTGCCTGGCATGAACCGCCCACTGGCCAGCACCGTGAACGACAAGC<br>TGGAGCTGCAGGAGTGCCTGGAGCACGGAAGGATCGCCAAGTTCTCCAAG<br>GTGCGGACAATCACCACAAGATCTAACAGCATCAAGCAGGGCAAGGATCA<br>GCACTTCCCCGTGTTCATGAATGAGAAGGAGGACATCCTGTGGTGTACCGA<br>GATGGAGCGCGTGTTCGGCTTTCCAGTGCACTATACAGACGTGAGCAATAT<br>GAGCCGGCTGGCAAGGCAGAGACTGCTGGGCCGGTCCTGGTCTGTGCCAG<br>TGATCAGACACCTGTTCGCCCCCCTGAAGGAGTACTTTGCCTGCGTGTCTA | 3xFLAG-<br>DNMT3AL-<br>XTEN80-SV40<br>NLS-ZFP-SV40<br>NLS-KRAB<br>(DNA sequence) |

TABLE E6-continued

DNMT3A/L-eZFP-KRAB fusion proteins

| SEQ ID NOs | Sequence | Description |
|---|---|---|
|  | GCGGCAACTCTAATGCCAACAGCAGAGGCCCTTCCTTTTCCTCTGGCCTGG<br>TGCCACTGTCTCTGAGGGGCAGCCACATGGGCCCCATGGAGATCTACAAG<br>ACCGTGTCCGCCTGGAAGAGGCAGCCTGTGCGCGTGCTGTCTCTGTTCCGC<br>AACATCGACAAGGTGCTGAAGAGCCTGGGCTTTCTGGAGAGCGGATCCGG<br>ATCTGGAGGAGGCACCCTGAAGTATGTGGAGGATGTGACAAATGTGGTGC<br>GGAGAGATGTGGAGAAGTGGGGCCCCTTCGATCTGGTGTACGGATCCACC<br>CAGCCACTGGGAAGCTCCTGCGATAGGTGTCCAGGATGGTATATGTTCCAG<br>TTTCACAGAATCCTGCAGTACGCACTGCCAAGGCAGGAGAGCCAGCGCCC<br>TTTCTTTTGGATCTTTATGGACAACCTGCTGCTGACAGAGGATGACCAGGA<br>GACAACAACCCGCTTCCTGCAGACAGAGGCAGTGACCCTGCAGGATGTGA<br>GGGGACGCGACTATCAGAATGCCATGCGGGTGTGGTCTAACATCCCTGGC<br>CTGAAGAGCAAGCACGCCCCCCTGACCCCTAAGGAGGAGGAGTACCTGCA<br>GGCCCAGGTGCGGAGCAGATCCAAGCTGGATGCCCCTAAGGTGGACCTGC<br>TGGTGAAGAATTGTCTGCTGCCACTGCGGGAGTACTTCAAGTACTTTAGTC<br>AGAATAGCCTGCCACTGGGTGGACCTAGCTCTGGAGCCCCGCCTCCGTCAG<br>GTGGATCTCCTGCAGGTAGCCCAACTTCCACGGAAGAGGGCACGTCTGAG<br>AGTGCGACTCCTGAGAGCGGGCCTGGCACAAGTACTGAGCCCAGCGAAGG<br>TTCTGCACCCGGGTCTCCAGCTGGGAGCCCTACCTCAACAGAGGAAGGTAC<br>CAGCACAGAGCCTTCTGAGGGTAGCGCTCCTGGCACGTCCACCGAACCGTC<br>CGAGGGGATGGCACCGAAGAAAAAACGCAAAGTTGGTCGACTTGAGCCGG<br>GGGAAAAGCCTTATGCTTGCCCAGAGTGTGGCAAGAGCTTCTCCCCAAAGTT<br>CAAACCTCGTCCGACACCAAAGGACTCACACGGGCGAAAAACCGTATAAA<br>TGCCCCGAGTGCGGAAAGTCATTTTCCAGGTCCGACGATCTGGTCCGCCAC<br>CAGCGCACTCATACGGGGGAAAAGCCCTATAAGTGCCCTGAGTGCGGCAA<br>GAGCTTCTCAACTCACCTGGATCTCATTCGCCATCAACGCACACATACAGG<br>GGAGAAGCCTTACGCTTGTCCAGAGTGCGGCAAGTCTTTCAGTACGAGCG<br>GAAACCTGACGGAACACCAGCGAACCCACACGGGCGAGAAGCCATATAA<br>ATGTCCCGAATGTGGAAAATCATTCTCTCGCCGATCTGCGTGCCGCCGGCA<br>TCAGAGGACACATACCGGAGAAAAGCCGTACAAATGCCCCGAGTGTGGAA<br>AATCCTTTAGCAGAAATGATACACTTACCGAGCATCAGAGGACGCACACT<br>GGAAAAAAGACATCTGCTCCGGACCGAAAAAAAAGAGAAAGGTAAACGG<br>CGGGGGAGGATCACGGACCCTGGTTACATTTAAGGACGTTTTTGTAGACTT<br>CACGAGGGAGGAATGGAAGCTGTTGGACACCGCCCAGCAAATCGTGTATC<br>GAAATGTAATGTTGGAAAATTATAAAAATCTGGTTTCCCTCGGCTACCAAT<br>TGACAAAACCAGACGTCATCCTCAGACTGGAAAAAGGGGAAGAACCTTGG<br>CTTGTCTGA |  |
| 1000 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PAAMAERPFQCRICMRNFSSEADRSRHIRTHTGEKPFACDICGRKFADRSNLTR<br>HTKIHTGSQKPFQCRICMRNFSQSSDLSRHIRTHTGEKPFACDICGRKFAYHWY<br>LKKHTKIHTGSQKPFQCRICMRNFSRSDSLSVHIRTHTGEKPFACDICGRKFAQ<br>NANRKTHTKIHLRQKDAARGSGPKKKRKVNGGGGSRTLVTFKDVFVDFTREE<br>WKLLDTAQQIVYRNVMLENYKNLVSLGYQLTKPDVILRLEKGEEPWLV | 3xFLAG-<br>DNMT3AL-<br>XTEN80-SV40<br>NLS-ZFP-SV40<br>NLS-KRAB (AA sequence) |
| 1001 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PAAMAERPFQCRICMRNFSRSDVLSTHIRTHTGEKPFACDICGKKFADNSSRTR<br>HTKIHTGSQKPFQCRICMRNFSRPYTLRLHIRTHTGEKPFACDICGRKFADSSH<br>RTRHTKIHTGSQKPFQCRICMRNFSRSDHLSQHIRTHTGEKPFACDICGRKFAD<br>SSHRTRHTKIHLRQKDAARGSGPKKKRKVNGGGGSRTLVTFKDVFVDFTREE<br>WKLLDTAQQIVYRNVMLENYKNLVSLGYQLTKPDVILRLEKGEEPWLV | 3xFLAG-<br>DNMT3AL-<br>XTEN80-SV40<br>NLS-ZFP-SV40<br>NLS-KRAB (AA sequence) |

TABLE E6-continued

DNMT3A/L-eZFP-KRAB fusion proteins

| SEQ ID NOs | Sequence | Description |
|---|---|---|
| 1002 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PAAMAERPFQCRICMRNFSRSDHLSQHIRTHTGEKPFACDICGRKFAQSADRT<br>KHTKIHTGSQKPFQCRICMRNFSRSDHLSQHIRTHTGEKPFACDICGRKFARRS<br>DLKRHTKIHTGSQKPFQCRICMRNFSRSDHLSRHIRTHTGEKPFACDICGRKFA<br>QSSDLRRHTKIHLRQKDAARGSGPKKKRKVNGGGGSRTLVTFKDVFVDFTRE<br>EWKLLDTAQQIVYRNVMLENYKNLVSLGYQLTKPDVILRLEKGEEPWLV | 3xFLAG-<br>DNMT3AL-<br>XTEN80-SV40<br>NLS-ZFP-SV40<br>NLS-KRAB (AA<br>sequence) |
| 1003 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PAAMAERPFQCRICMRNFSRSDNLSEHIRTHTGEKPFACDICGRKFATSSNRKT<br>HTKIHTGSQKPFQCRICMRNFSDRSHLTRHIRTHTGEKPFACDICGRKFARSDA<br>LTQHTKIHTGSQKPFQCRICMRNFSDRSALARHIRTHTGEKPFACDICGRKFAR<br>RFTLSKHTKIHLRQKDAARGSGPKKKRKVNGGGGSRTLVTFKDVFVDFTREE<br>WKLLDTAQQIVYRNVMLENYKNLVSLGYQLTKPDVILRLEKGEEPWLV | 3xFLAG-<br>DNMT3AL-<br>XTEN80-SV40<br>NLS-ZFP-SV40<br>NLS-KRAB (AA<br>sequence) |
| 1004 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PAAMAERPFQCRICMRNFSRSDHLSEHIRTHTGEKPFACDICGRKFAQYSGRY<br>YHTKIHTGSQKPFQCRICMRNFSHGQTLNEHIRTHTGEKPFACDICGRKFAQSG<br>NLARHTKIHTGSQKPFQCRICMRNFSRSDSLLRHIRTHTGEKPFACDICGRKFA<br>CREYRGKHTKIHLRQKDAARGSGPKKKRKVNGGGGSRTLVTFKDVFVDFTRE<br>EWKLLDTAQQIVYRNVMLENYKNLVSLGYQLTKPDVILRLEKGEEPWLV | 3xFLAG-<br>DNMT3AL-<br>XTEN80-SV40<br>NLS-ZFP-SV40<br>NLS-KRAB (AA<br>sequence) |
| 1005 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PAAMAERPFQCRICMRNFSQSANRTTHIRTHTGEKPFACDICGRKFARSANLT<br>RHTKIHTGSQKPFQCRICMRNFSRSDVLSEHIRTHTGEKPFACDICGRKFATSG<br>HLSRHTKIHTGSQKPFQCRICMRNFSQSSDLSRHIRTHTGEKPFACDICGRKFA<br>QWSTRKRHTKIHLRQKDAARGSGPKKKRKVNGGGGSRTLVTFKDVFVDFTR<br>EEWKLLDTAQQIVYRNVMLENYKNLVSLGYQLTKPDVILRLEKGEEPWLV | 3xFLAG-<br>DNMT3AL-<br>XTEN80-SV40<br>NLS-ZFP-SV40<br>NLS-KRAB (AA<br>sequence) |

TABLE E6-continued

DNMT3A/L-eZFP-KRAB fusion proteins

| SEQ ID NOs | Sequence | Description |
|---|---|---|
| 1006 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PAAMAERPFQCRICMRNFSQSGNLARHIRTHTGEKPFACDICGRKFAATCCLA<br>HHTKIHTGSQKPFQCRICMRNFSRWQYLPTHIRTHAGEKPFACDICGRKFADR<br>SALARHTKIHTGSQKPFQCRICMRNFSRSDNLSEHIRTHTGEKPFACDICGRKF<br>AKRCNLRCHTKIHLRQKDAARGSGPKKKRKVNGGGGSRTLVTFKDVFVDFTR<br>EEWKLLDTAQQIVYRNVMLENYKNLVSLGYQLTKPDVILRLEKGEEPWLV | 3xFLAG-<br>DNMT3AL-<br>XTEN80-SV40<br>NLS-ZFP-SV40<br>NLS-KRAB (AA sequence) |
| 1007 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PAAMAERPFQCRICMRNFSNPANLTRHIRTHTGEKPFACDICGRKFAQNATRT<br>KHTKIHTGSQKPFQCRICMRNFSQSGHLARHIRTHTGEKPFACDICGRKFANRH<br>DRAKHTKIHTGSQKPFQCRICMRNFSRSDHLSEHIRTHTGEKPFACDICGRKFA<br>QRRSRYKHTKIHLRQKDAARGSGPKKKRKVNGGGGSRTLVTFKDVFVDFTRE<br>EWKLLDTAQQIVYRNVMLENYKNLVSLGYQLTKPDVILRLEKGEEPWLV | 3xFLAG-<br>DNMT3AL-<br>XTEN80-SV40<br>NLS-ZFP-SV40<br>NLS-KRAB (AA sequence) |
| 1008 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PAAMAERPFQCRICMRNFSQSSDLSRHIRTHTGEKPFACDICGRKFAHRSTRNR<br>HTKIHTGSQKPFQCRICMRNFSRSDVLSAHIRTHTGEKPFACDICGRKFADSRT<br>RKNHTKIHTGSQKPFQCRICMRNFSQSGSLTRHIRTHTGEKPFACDICGRKFAD<br>QSGLAHHTKIHLRQKDAARGSGPKKKRKVNGGGGSRTLVTFKDVFVDFTREE<br>WKLLDTAQQIVYRNVMLENYKNLVSLGYQLTKPDVILRLEKGEEPWLV | 3xFLAG-<br>DNMT3AL-<br>XTEN80-SV40<br>NLS-ZFP-SV40<br>NLS-KRAB (AA sequence) |
| 1009 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PAAMAERPFQCRICMRNFSQNPAQWRHIRTHTGEKPFACDICGRKFARSADLS<br>RHTKIHTGSQKPFQCRICMRNFSTSGSLSRHIRTHTGEKPFACDICGRKFARSD<br>HLSRHTKIHTGSQKPFQCRICMRNFSRSDSLLRHIRTHTGEKPFACDICGRKFA<br>QSYDRFQHTKIHLRQKDAARGSGPKKKRKVNGGGGSRTLVTFKDVFVDFTRE<br>EWKLLDTAQQIVYRNVMLENYKNLVSLGYQLTKPDVILRLEKGEEPWLV | 3xFLAG-<br>DNMT3AL-<br>XTEN80-SV40<br>NLS-ZFP-SV40<br>NLS-KRAB (AA sequence) |

TABLE E6-continued

DNMT3A/L-eZFP-KRAB fusion proteins

| SEQ ID NOs | Sequence | Description |
|---|---|---|
| 1010 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PAAMAERPFQCRICMRNFSTSGSLSRHIRTHTGEKPFACDICGRKFARSDHLSR<br>HTKIHTGSQKPFQCRICMRNFSRSDSLLRHIRTHTGEKPFACDICGRKFAQSYD<br>RFQHTKIHTGSQKPFQCRICMRNFSRSDNLSTHIRTHTGEKPFACDICGRKFAD<br>NRDRIKHTKIHLRQKDAARGSGPKKKRKVNGGGGSRTLVTFKDVFVDFTREE<br>WKLLDTAQQIVYRNVMLENYKNLVSLGYQLTKPDVILRLEKGEEPWLV | 3xFLAG-<br>DNMT3AL-<br>XTEN80-SV40<br>NLS-ZFP-SV40<br>NLS-KRAB (AA<br>sequence) |
| 1011 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PAAMAERPFQCRICMRNFSDRSNLSRHIRTHTGEKPFACDICGRKFALRQNLIM<br>HTKIHTGSQKPFQCRICMRNFSERGTLARHIRTHTGEKPFACDICGRKFARSDA<br>LTQHTKIHTGSQKPFQCRICMRNFSRSDSLSQHIRTHTGEKPFACDICGRKFAR<br>KADRTRHTKIHLRQKDAARGSGPKKKRKVNGGGGSRTLVTFKDVFVDFTREE<br>WKLLDTAQQIVYRNVMLENYKNLVSLGYQLTKPDVILRLEKGEEPWLV | 3xFLAG-<br>DNMT3AL-<br>XTEN80-SV40<br>NLS-ZFP-SV40<br>NLS-KRAB (AA<br>sequence) |
| 1012 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PAAMAERPFQCRICMRNFSQYCCLTNHIRTHTGEKPFACDICGRKFATSGNLT<br>RHTKIHTGSQKPFQCRICMRNFSQSSDLSRHIRTHTGEKPFACDICGRKFAFRY<br>YLKRHTKIHTGSQKPFQCRICMRNFSQSGDLTRHIRTHTGEKPFACDICGRKFA<br>DKGNLTKHTKIHLRQKDAARGSGPKKKRKVNGGGGSRTLVTFKDVFVDFTRE<br>EWKLLDTAQQIVYRNVMLENYKNLVSLGYQLTKPDVILRLEKGEEPWLV | 3xFLAG-<br>DNMT3AL-<br>XTEN80-SV40<br>NLS-ZFP-SV40<br>NLS-KRAB (AA<br>sequence) |
| 1013 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PAAMAERPFQCRICMRNFSTSGSLSRHIRTHTGEKPFACDICGRKFARSDNLTT<br>HTKIHTGSQKPFQCRICMRNFSQSGNLARHIRTHTGEKPFACDICGRKFADRTT<br>LMRHTKIHTGSQKPFQCRICMRNFSQSGHLARHIRTHTGEKPFACDICGRKFA<br>QLTHLNSHTKIHLRQKDAARGSGPKKKRKVNGGGGSRTLVTFKDVFVDFTRE<br>EWKLLDTAQQIVYRNVMLENYKNLVSLGYQLTKPDVILRLEKGEEPWLV | 3xFLAG-<br>DNMT3AL-<br>XTEN80-SV40<br>NLS-ZFP-SV40<br>NLS-KRAB (AA<br>sequence) |

TABLE E6-continued

DNMT3A/L-eZFP-KRAB fusion proteins

| SEQ ID NOs | Sequence | Description |
|---|---|---|
| 1014 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PAAMAERPFQCRICMRNFSIKHDLHRHIRTHTGEKPFACDICGRKFARSANLTR<br>HTKIHTGSQKPFQCRICMRNFSRSDNLARHIRTHTGEKPFACDICGRKFAQNVS<br>RPRHTKIHTGSQKPFQCRICMRNFSRSDDLSKHIRTHTGEKPFACDICGRKFAD<br>SSHRTRHTKIHLRQKDAARGSGPKKKRKVNGGGGSRTLVTFKDVFVDFTREE<br>WKLLDTAQQIVYRNVMLENYKNLVSLGYQLTKPDVILRLEKGEEPWLV | 3xFLAG-DNMT3AL-XTEN80-SV40 NLS-ZFP-SV40 NLS-KRAB (AA sequence) |
| 1015 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PAAMAERPFQCRICMRNFSRSDNLARHIRTHTGEKPFACDICGRKFAQNVSRP<br>RHTKIHTGSQKPFQCRICMRNFSRSDDLSKHIRTHTGEKPFACDICGRKFADSS<br>HRTRHTKIHTGSQKPFQCRICMRNFSTSSNRKTHIRTHTGEKPFACDICGRKFA<br>AQWTRACHTKIHLRQKDAARGSGPKKKRKVNGGGGSRTLVTFKDVFVDFTR<br>EEWKLLDTAQQIVYRNVMLENYKNLVSLGYQLTKPDVILRLEKGEEPWLV | 3xFLAG-DNMT3AL-XTEN80-SV40 NLS-ZFP-SV40 NLS-KRAB (AA sequence) |
| 1016 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PAAMAERPFQCRICMRNFSRSDDLSKHIRTHTGEKPFACDICGRKFADSSHRTR<br>HTKIHTGSQKPFQCRICMRNFSTSSNRKTHIRTHTGEKPFACDICGRKFAAQWT<br>RACHTKIHTGSQKPFQCRICMRNFSRKQTRTTHIRTHTGEKPFACDICGRKFAH<br>RSSLRRHTKIHLRQKDAARGSGPKKKRKVNGGGGSRTLVTFKDVFVDFTREE<br>WKLLDTAQQIVYRNVMLENYKNLVSLGYQLTKPDVILRLEKGEEPWLV | 3xFLAG-DNMT3AL-XTEN80-SV40 NLS-ZFP-SV40 NLS-KRAB (AA sequence) |
| 1017 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PAAMAERPFQCRICMRNFSQSAHRKNHIRTHTGEKPFACDICGRKFATSSNRK<br>THTKIHTGSQKPFQCRICMRNFSRSDNLSAHIRTHTGEKPFACDICGRKFARNN<br>DRKTHTKIHTGSQKPFQCRICMRNFSTSGSLSRHIRTHTGEKPFACDICGRKFA<br>QAGHLAKHTKIHLRQKDAARGSGPKKKRKVNGGGGSRTLVTFKDVFVDFTR<br>EEWKLLDTAQQIVYRNVMLENYKNLVSLGYQLTKPDVILRLEKGEEPWLV | 3xFLAG-DNMT3AL-XTEN80-SV40 NLS-ZFP-SV40 NLS-KRAB (AA sequence) |

TABLE E6-continued

DNMT3A/L-eZFP-KRAB fusion proteins

| SEQ ID NOs | Sequence | Description |
|---|---|---|
| 1018 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PAAMAERPFQCRICMRNFSRSDHLSQHIRTHTGEKPFACDICGRKFAASSTRTK<br>HTKIHTGSQKPFQCRICMRNFSRSDDLTRHIRTHTGEKPFACDICGRKFAQKSN<br>LSSHTKIHTGSQKPFQCRICMRNFSQSANRTTIHIRTHTGEKPFACDICGRKFAQ<br>NATRTKHTKIHLRQKDAARGSGPKKKRKVNGGGGSRTLVTFKDVFVDFTREE<br>WKLLDTAQQIVYRNVMLENYKNLVSLGYQLTKPDVILRLEKGEEPWLV | 3xFLAG-<br>DNMT3AL-<br>XTEN80-SV40<br>NLS-ZFP-SV40<br>NLS-KRAB (AA sequence) |
| 1019 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PAAMAERPFQCRICMRNFSRSDTLSEHIRTHTGEKPFACDICGRKFARRWTLV<br>GHTKIHTGSQKPFQCRICMRNFSDRSNLSRHIRTHTGEKPFACDICGRKFAQSG<br>DLTRHTKIHTGSQKPFQCRICMRNFSQSSDLSRHIRTHTGEKPFACDICGRKFA<br>YHWYLKKHTKIHLRQKDAARGSGPKKKRKVNGGGGSRTLVTFKDVFVDFTR<br>EEWKLLDTAQQIVYRNVMLENYKNLVSLGYQLTKPDVILRLEKGEEPWLV | 3xFLAG-<br>DNMT3AL-<br>XTEN80-SV40<br>NLS-ZFP-SV40<br>NLS-KRAB (AA sequence) |
| 1020 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PAAMAERPFQCRICMRNFSRSANLARHIRTHTGEKPFACDICGRKFARSDNLR<br>EHTKIHTGSQKPFQCRICMRNFSRPYTLRLHIRTHTGEKPFACDICGRKFAHRS<br>NLNKHTKIHTGSQKPFQCRICMRNFSQSGSLTRHIRTHTGEKPFACDICGRKFA<br>TSANLSRHTKIHLRQKDAARGSGPKKKRKVNGGGGSRTLVTFKDVFVDFTRE<br>EWKLLDTAQQIVYRNVMLENYKNLVSLGYQLTKPDVILRLEKGEEPWLV | 3xFLAG-<br>DNMT3AL-<br>XTEN80-SV40<br>NLS-ZFP-SV40<br>NLS-KRAB (AA sequence) |
| 1021 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PLEPGEKPYACPECGKSFSRSDDLVRHQRTHTGEKPYKCPECGKSFSTGSLVR<br>HQRTHTGEKPYKCPECGKSFSRSDKLVRHQRTHTGEKPYACPECGKSFSRSDE<br>LVRHQRTHTGEKPYKCPECGKSFSTSHSLTEHQRTHTGEKPYKCPECGKSFSR<br>ADNLTEHQRTHTGKKTSGSGPKKKRKVNGGGGSRTLVTFKDVFVDFTREEW<br>KLLDTAQQIVYRNVMLENYKNLVSLGYQLTKPDVILRLEKGEEPWLV | 3xFLAG-<br>DNMT3AL-<br>XTEN80-SV40<br>NLS-ZFP-SV40<br>NLS-KRAB (AA sequence) |

TABLE E6-continued

DNMT3A/L-eZFP-KRAB fusion proteins

| SEQ ID NOs | Sequence | Description |
|---|---|---|
| 1022 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PLEPGEKPYACPECGKSFSERSHLREHQRTHTGEKPYKCPECGKSFSTSHSLTE<br>HQRTHTGEKPYKCPECGKSFSQAGHLASHQRTHTGEKPYACPECGKSFSTSHS<br>LTEHQRTHTGEKPYKCPECGKSFSDPGHLVRHQRTHTGEKPYKCPECGKSFST<br>SGNLVRHQRTHTGKKTSGSGPKKKRKVNGGGGSRTLVTFKDVFVDFTREEW<br>KLLDTAQQIVYRNVMLENYKNLVSLGYQLTKPDVILRLEKGEEPWLV | 3xFLAG-<br>DNMT3AL-<br>XTEN80-SV40<br>NLS-ZFP-SV40<br>NLS-KRAB (AA<br>sequence) |
| 1023 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PLEPGEKPYKCPECGKSFSRADNLTEHQRTHTGEKPYKCPECGKSFSTSGSLVR<br>HQRTHTGEKPYKCPECGKSFSRKDNLKNHQRTHTGEKPYKCPECGKSFSQSSS<br>LVRHQRTHTGEKPYKCPECGKSFSRSDKLVRHQRTHTGEKPYKCPECGKSFSD<br>SGNLRVHQRTHTGKKTSGSGPKKKRKVNGGGGSRTLVTFKDVFVDFTREEW<br>KLLDTAQQIVYRNVMLENYKNLVSLGYQLTKPDVILRLEKGEEPWLV | 3xFLAG-<br>DNMT3AL-<br>XTEN80-SV40<br>NLS-ZFP-SV40<br>NLS-KRAB (AA<br>sequence) |
| 1024 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PLEPGEKPYACPECGKSFSQSSSLVRHQRTHTGEKPYKCPECGKSFSQSGDLRR<br>HQRTHTGEKPYKCPECGKSFSRSDERKRHQRTHTGEKPYACPECGKSFSHRTT<br>LTNHQRTHTGEKPYKCPECGKSFSRSDHLTNHQRTHTGEKPYKCPECGKSFST<br>SGELVRHQRTHTGKKTSGSGPKKKRKVNGGGGSRTLVTFKDVFVDFTREEW<br>KLLDTAQQIVYRNVMLENYKNLVSLGYQLTKPDVILRLEKGEEPWLV | 3xFLAG-<br>DNMT3AL-<br>XTEN80-SV40<br>NLS-ZFP-SV40<br>NLS-KRAB (AA<br>sequence) |
| 1025 | MHDQEFDPPKVYPPVPAEKRKPIRVLSLFDGIATGLLVLKDLGIQVDRYIASEV<br>CEDSITVGMVRHQGKIMYVGDVRSVTQKHIQEWGPFDLVIGGSPCNDLSIVNP<br>ARKGLYEGTGRLFFEFYRLLHDARPKEGDDRPFFWLFENVVAMGVSDKRDIS<br>RFLESNPVMIDAKEVSAAHRARYFWGNLPGMNRPLASTVNDKLELQECLEHG<br>RIAKFSKVRTITTRSNSIKQGKDQHFPVFMNEKEDILWCTEMERVFGFPVHYT<br>DVSNMSRLARQRLLGRSWSVPVIRHLFAPLKEYFACVSSGNSNANSRGPSFSS<br>GLVPLSLRGSHMGPMEIYKTVSAWKRQPVRVLSLFRNIDKVLKSLGFLESGSG<br>SGGGTLKYVEDVTNVVRRDVEKWGPFDLVYGSTQPLGSSCDRCPGWYMFQF<br>HRILQYALPRQESQRPFFWIFMDNLLLTEDDQETTTRFLQTEAVTLQDVRGRD<br>YQNAMRVWSNIPGLKSKHAPLTPKEEEYLQAQVRSRSKLDAPKVDLLVKNCL<br>LPLREYFKYFSQNSLPLGGPSSGAPPPSGGSPAGSPTSTEEGTSESATPESGPGTS<br>TEPSEGSAPGSPAGSPTSTEEGTSTEPSEGSAPGTSTEPSEGMAPKKKRKVGRV<br>PLEPGEKPYACPECGKSFSQSGDLRRHQRTHTGEKPYKCPECGKSFSRSDERK<br>RHQRTHTGEKPYKCPECGKSFSHRTTLTNHQRTHTGEKPYACPECGKSFSRSD<br>HLTNHQRTHTGEKPYKCPECGKSFSTSGELVRHQRTHTGEKPYKCPECGKSFS<br>RSDDLVRHQRTHTGKKTSGSGPKKKRKVNGGGGSRTLVTFKDVFVDFTREE<br>WKLLDTAQQIVYRNVMLENYKNLVSLGYQLTKPDVILRLEKGEEPWLV | 3xFLAG-<br>DNMT3AL-<br>XTEN80-SV40<br>NLS-ZFP-SV40<br>NLS-KRAB (AA<br>sequence) |

TABLE E6-continued

DNMT3A/L-eZFP-KRAB fusion proteins

| SEQ ID NOs | Sequence | Description |
|---|---|---|
| 1026 | MHDQEFDPPKVYPPVPAEKRKPIRVLSLFDGIATGLLVLKDLGIQVDRYIASEV CEDSITVGMVRHQGKIMYVGDVRSVTQKHIQEWGPFDLVIGGSPCNDLSIVNP ARKGLYEGTGRLFFEFYRLLHDARPKEGDDRPFFWLFENVVAMGVSDKRDIS RFLESNPVMIDAKEVSAAHRARYFWGNLPGMNRPLASTVNDKLELQECLEHG RIAKFSKVRTITTRSNSIKQGKDQHFPVFMNEKEDILWCTEMERVFGFPVHYT DVSNMSRLARQRLLGRSWSVPVIRHLFAPLKEYFACVSSGNSNANSRGPSFSS GLVPLSLRGSHMGPMEIYKTVSAWKRQPVRVLSLFRNIDKVLKSLGFLESGSG SGGGTLKYVEDVTNVVRRDVEKWGPFDLVYGSTQPLGSSCDRCPGWYMFQF HRILQYALPRQESQRPFFWIFMDNLLLTEDDQETTTRFLQTEAVTLQDVRGRD YQNAMRVWSNIPGLKSKHAPLTPKEEEYLQAQVRSRSKLDAPKVDLLVKNCL LPLREYFKYFSQNSLPLGGPSSGAPPPSGGSPAGSPTSTEEGTSESATPESGPGTS TEPSEGSAPGSPAGSPTSTEEGTSTEPSEGSAPGTSTEPSEGMAPKKKRKVGRV PLEPGEKPYACPECGKSFSQRAHLERHQRTHTGEKPYKCPECGKSFSQLAHLR AHQRTHTGEKPYKCPECGKSFSDPGHLVRHQRTHTGEKPYKCPECGKSFSRRS ACRRHQRTHTGEKPYKCPECGKSFSRSDHLTTHQRTHTGEKPYKCPECGKSFS QSSSLVRHQRTHTGKKTSGSGPKKKRKVNGGGGSRTLVTFKDVFVDFTREEW KLLDTAQQIVYRNVMLENYKNLVSLGYQLTKPDVILRLEKGEEPWLV | 3xFLAG-DNMT3AL-XTEN80-SV40 NLS-ZFP-SV40 NLS-KRAB (AA sequence) |
| 1027 | MHDQEFDPPKVYPPVPAEKRKPIRVLSLFDGIATGLLVLKDLGIQVDRYIASEV CEDSITVGMVRHQGKIMYVGDVRSVTQKHIQEWGPFDLVIGGSPCNDLSIVNP ARKGLYEGTGRLFFEFYRLLHDARPKEGDDRPFFWLFENVVAMGVSDKRDIS RFLESNPVMIDAKEVSAAHRARYFWGNLPGMNRPLASTVNDKLELQECLEHG RIAKFSKVRTITTRSNSIKQGKDQHFPVFMNEKEDILWCTEMERVFGFPVHYT DVSNMSRLARQRLLGRSWSVPVIRHLFAPLKEYFACVSSGNSNANSRGPSFSS GLVPLSLRGSHMGPMEIYKTVSAWKRQPVRVLSLFRNIDKVLKSLGFLESGSG SGGGTLKYVEDVTNVVRRDVEKWGPFDLVYGSTQPLGSSCDRCPGWYMFQF HRILQYALPRQESQRPFFWIFMDNLLLTEDDQETTTRFLQTEAVTLQDVRGRD YQNAMRVWSNIPGLKSKHAPLTPKEEEYLQAQVRSRSKLDAPKVDLLVKNCL LPLREYFKYFSQNSLPLGGPSSGAPPPSGGSPAGSPTSTEEGTSESATPESGPGTS TEPSEGSAPGSPAGSPTSTEEGTSTEPSEGSAPGTSTEPSEGMAPKKKRKVGRV PLEPGEKPYACPECGKSFSQSSNLVRHQRTHTGEKPYKCPECGKSFSRSDDLV RHQRTHTGEKPYKCPECGKSFSTHLDLIRHQRTHTGEKPYACPECGKSFSTSG NLTEHQRTHTGEKPYKCPECGKSFSRRSACRRHQRTHTGEKPYKCPECGKSFS RNDTLTEHQRTHTGKKTSGSGPKKKRKVNGGGGSRTLVTFKDVFVDFTREEW KLLDTAQQIVYRNVMLENYKNLVSLGYQLTKPDVILRLEKGEEPWLV | 3xFLAG-DNMT3AL-XTEN80-SV40 NLS-ZFP-SV40 NLS-KRAB (AA sequence) |

The present invention is not intended to be limited in scope to the particular disclosed embodiments, which are provided, for example, to illustrate various aspects of the invention. Various modifications to the compositions and methods described will become apparent from the description and teachings herein. Such variations may be practiced without departing from the true scope and spirit of the disclosure and are intended to fall within the scope of the present disclosure.

| SEQ ID NO | Sequence | Description |
|---|---|---|
| 586 | GTTTAAGAGCTATGCTGGAAACAGCATAGCAAGTTTAAATAAGGCTAG TCCGTTATCAACTTGAAAAAGTGGCACCGAGTCGGTGC | SpCas9 gRNA scaffold sequence (DNA) |
| 587 | GUUUAAGAGCUAUGCUGGAAACAGCAUAGCAAGUUUAAAUAAGGCU AGUCCGUUAUCAACUUGAAAAAGUGGCACCGAGUCGGUGC | SpCas9 gRNA scaffold sequence (RNA) |
| 588 | NGG | S. pyogenes Cas9 protospacer adjacent motif |
| 589 | NNGRRT | S. aureus Cas9 protospacer adjacent motif |
| 590 | RTLVTFKDVFVDFTREEWKLLDTAQQILYRNVMLENYKNLVSLGYQLTKP DVILRLEKGEEPWLV | KRAB (AA) |
| 591 | CGGACACTGGTGACCTTCAAGGATGTGTTTGTGGACTTCACCAGGGAGG AGTGGAAGCTGCTGGACACTGCTCAGCAGATCCTGTACAGAAATGTGA TGCTGGAGAACTATAAGAACCTGGTTTCCTTGGGTTATCAGCTTACTAA | KRAB (nt) |

| SEQ ID NO | Sequence | Description |
|---|---|---|
| | GCCAGATGTGATCCTCCGGTTGGAGAAGGGAGAAGAGCCCTGGCTGGT<br>G | |
| 592 | KRPAATKKAGQAKKKK | NLS (AA) |
| 593 | PKKKRKV | NLS-2 (AA) |
| 594 | CCAAAGAAGAAGCGGAAGGTCGGTATCCACGGAGTCCCAGCAGCCGAC<br>AAGAAGTACTCCATTGGGCTCGCCATCGGCACAAACAGCGTCGGCTGG<br>GCCGTCATTACGGACGAGTACAAGGTGCCGAGCAAAAAATTCAAAGTT<br>CTGGGCAATACCGATCGCCACAGCATAAAGAAGAACCTCATTGGCGCC<br>CTCCTGTTCGACTCCGGGGAAACCGCCGAAGCCACGCGGCTCAAAAGA<br>ACAGCACGGCGCAGATATACCCGCAGAAAGAATCGGATCTGCTACCtgca<br>GGAGATCTTTAGTAATGAGATGGCTAAGGTGGATGACTCTTTCTTCCAT<br>AGGCTGGAGGAGTCCTTTTTGGTGGAGGAGGATAAAAAGCACGAGCGC<br>CACCCAATCTTTGGCAATATCGTGGACGAGGTGGCGTACCATGAAAAGT<br>ACCCAACCATATATCATCTGAGGAAGAAGCTTGTAGACAGTACTGATA<br>AGGCTGACTTGCGGTTGATCTATCTCGCGCTGGCGCATATGATCAAATT<br>TCGGGGACACTTCCTCATCGAGGGGGACCTGAACCCAGACAACAGCGA<br>TGTCGACAAACTCTTTATCCAACTGGTTCAGACTTACAATCAGCTTTTCG<br>AAGAGAACCCGATCAACCATCCGGAGTTGACGCCAAAGCAATCCTGA<br>GCGCTAGGCTGTCCAAATCCCGGCGGCTCGAAAACCTCATCGCACAGCT<br>CCCTGGGGAGAAGAAGAACGGCCTGTTTGGTAATCTTATCGCCCTGTCA<br>CTCGGGCTGACCCCCAACTTTAAATCTAACTTCGACCTGGCCGAAGATG<br>CCAAGCTTCAACTGAGCAAAGACACCTACGATGATGATCTCGACAATCT<br>GCTGGCCCAGATCGGCGACCAGTACGCAGACCTTTTTTTGGCGGCAAAG<br>AACCTGTCAGACGCCATTCTGCTGAGTGATATTCTGCGAGTGAACACGG<br>AGATCACCAAAGCTCCGCTGAGCGCTAGTATGATCAAGCGCTATGATG<br>AGCACCACCAAGACTTGACTTTGCTGAAGGCCCTTGTCAGACAGCAACT<br>GCCTGAGAAGTACAAGGAAATTTTCTTCGATCAGTCTAAAAATGGCTAC<br>GCCGGATACATTGACGGCGGAGCAAGCCAGGAGGAATTTTACAAATTT<br>ATTAAGCCCATCTTGGAAAAAATGGACGGCACCGAGGAGCTGCTGGTA<br>AAGCTTAACAGAGAAGATCTGTTGCGCAAACAGCGCACTTTCGACAAT<br>GGAAGCATCCCCCACCAGATTCACCTGGGCGAACTGCACGCTATCCTCA<br>GGCGGCAAGAGGATTCTACCCCTTTTTGAAAGATAACAGGGAAAAGA<br>TTGAGAAAATCCTCACATTTCGGATACCCTACTATGTAGGCCCCCTCGC<br>CCGGGGAAATTCCAGATTCGCGTGGATGACTCGCAAATCAGAAGAGAC<br>CATCACTCCCTGGAACTTCGAGGAAGTCGTGGATAAGGGGGCCTCTGCC<br>CAGTCCTTCATCGAAAGGATGACTAACTTTGATAAAAATCTGCCTAACG<br>AAAAGGTGCTTCCTAAACACTCTCTGCTGTACGAGTACTTCACAGTTTA<br>TAACGAGCTCACCAAGGTCAAATACGTCACAGAAGGGATGAGAAAGCC<br>AGCATTCCTGTCTGGAGAGCAGAAGAAAGCTATCGTGGACCTCCTCTTC<br>AAGACGAACCGGAAAGTTACCGTGAAACAGCTCAAAGAAGACTATTTC<br>AAAAAGATTGAATGTTTCGACTCTGTTGAAATCAGCGGAGTGGAGGAT<br>CGCTTCAACGCATCCCTGGGAACGTATCACGATCTCCTGAAAATCATTA<br>AAGACAAGGACTTCCTGGACAATGAGGAGAACGAGGACATTCTTGAGG<br>ACATTGTCCTCACCCTTACGTTGTTTGAAGATAGGGAGATGATTGAAGA<br>ACGCTTGAAAACTTACGCTCATCTCTTCGACGACAAAGTCATGAAACAG<br>CTCAAGAGGCGCCGATATACAGGATGGGGCGGCTGTCAAGAAAACTG<br>ATCAATGGgatcCGAGACAAGCAGAGTGGAAAGACAATCCTGGATTTTCT<br>TAAGTCCGATGGATTTGCCAACCGGAACTTCATGCAGTTGATCCATGAT<br>GACTCTCTCACCTTTAAGGAGGACATCCAGAAAGCACAAGTTTCTGGCC<br>AGGGGGACAGTCTTCACGAGCACATCGCTAATCTTGCAGGTAGCCCAG<br>CTATCAAAAAGGGAATACTGCAGACCGTTAAGGTCGTGGATGAACTCG<br>TCAAAGTAATGGGAAGGCATAAGCCCGAGAATATCGTTATCGAGATGG<br>CCCGAGAGAACCAAACTACCCAGAAGGGACAGAAGAACAGTAGGGAA<br>AGGATGAAGAGGATTGAAGAGGGTATAAAAGAACTGGGGTCCCAAATC<br>CTTAAGGAACACCCAGTTGAAAACACCCAGCTTCAGAATGAGAAGCTC<br>TACCTGTACTACCTGCAGAACGGCAGGGACATGTACGTGGATCAGGAA<br>CTGGACATCAATCGGCTCTCCGACTACGACGTGGATGCCATCGTGCCCC<br>AGTCTTTTCTCAAAGATGATTCTATTGATAATAAAGTGTTGACAAGATC<br>CGATAAAAATAGGGGAAGAGTGATAACGTCCCCTCAGAAGAAGTTGT<br>CAAGAAAATGAAAAATTATTGGCGGCAGCTGCTGAACGCCAAACTGAT<br>CACACAACGGAAGTTCGATAATCTGACTAAGGCTGAACGAGGTGGCCT<br>GTCTGAGTTGGATAAAGCCGGCTTCATCAAAAGGCAGCTTGTTGAGACA<br>CGCCAGATCACCAAgcacGTGGCCCAAATTCTCGATTCACGCATGAACAC<br>CAAGTACGATGAAAATGACAAACTGATTCGAGAGGTGAAAGTTATTAC<br>TCTGAAGTCTAAGCTGGTCTCAGATTTCAGAAAGGACTTTCAGTTTTAT<br>AAGGTGAGAGAGATCAACAATTACCACCATGCGCATGATGCCTACCTG<br>AATGCAGTGGTAGGCACTGCACTTATCAAAAAATATCCCAAGCTTGAAT<br>CTGAATTTGTTTACGGAGACTATAAAGTGTACGATGTTAGGAAAATGAT<br>CGCAAAGTCTGAGCAGGAAATAGGCAAGGCCACCGCTAAGTACTTCTT<br>TTACAGCAATATTATGAATTTTTTCAAGACCGAGATTACACTGGCCAAT<br>GGAGAGATTCGGAAGCGACCACTTATCGAAACAAACGGAGAAACAGG | NLS2-dSpCas9-<br>NLS-KRAB-NLS2<br>(nt) |

-continued

Sequences

| SEQ ID NO | Sequence | Description |
|---|---|---|
|  | AGAAATCGTGTGGGACAAGGGTAGGGATTTCGCGACAGTCCGGAAGGT<br>CCTGTCCATGCCGCAGGTGAACATCGTTAAAAAGACCGAAGTACAGAC<br>CGGAGGCTTCTCCAAGGAAAGTATCCTCCCGAAAAGGAACAGCGACAA<br>GCTGATCGCACGCAAAAAAGATTGGGACCCCAAGAAATACGGCGGATT<br>CGATTCTCCTACAGTCGCTTACAGTGTACTGGTTGTGGCCAAAGTGGAG<br>AAAGGGAAGTCTAAAAAACTCAAAAGCGTCAAGGAACTGCTGGGCATC<br>ACAATCATGGAGCGATCAAGCTTCGAAAAAAACCCCATCGACTTTCTCG<br>AGGCGAAAGGATATAAAGAGGTCAAAAAAGACCTCATCATTAAGCTTC<br>CCAAGTACTCTCTCTTTGAGCTTGAAAACGGCCGGAAACGAATGCTCGC<br>TAGTGCGGGCGAGCTGCAGAAAGGTAACGAGCTGGCACTGCCCTCTAA<br>ATACGTTAATTTCTTGTATCTGGCCAGCCACTATGAAAAGCTCAAAGGG<br>TCTCCCGAAGATAATGAGCAGAAGCAGCTGTTCGTGGAACAACAAA<br>CACTACCTTGATGAGATCATCGAGCAAATAAGCGAATTCTCCAAAAGA<br>GTGATCCTCGCCGACGCTAACCTCGATAAGGTGCTTTCTGCTTACAATA<br>AGCACAGGGATAAGCCCATCAGGGAGCAGGCAGAAAACATTATCCACT<br>TGTTTACTCTGACCAACTTGGGCGCGCCTGCAGCCTTCAAGTACTTCGA<br>CACCACCATAGACAGAAAGCGGTACACCTCTACAAAGGAGGTCCTGGA<br>CGCCACACTGATTCATCAGTCAATTACGGGGCTCTATGAAACAAGAATC<br>GACCTCTCAGCTCGGTGGAGACAAAAGGCCGGCGGCCACGAAAAG<br>GCCGGCCAGGCAAAAAAGAAAAAGGctagCgatgctaagtcactgactgcctggtcccgga<br>cactggtgaccttcaaggatgtgtttgtggacttcaccaggagagtggaagctgctggacactgct<br>cagcagatcctgtacagaaatgtgatgctggagaactataagaacctggtttccttgggttatcagct<br>tactaagccagatgtgatcctccggttggagaagggagaagagccctggctggtggagagagaaattc<br>accaagagacccatcctgattcagagactgcatttgaaatcaaatcatcagttCCGAAAAAGAAACGC<br>AAAGTT |  |
| 595 | PKKKRKVGIHGVPAADKKYSIGLAIGTNSVGWAVITDEYKVPSKKFKVLG<br>NTDRHSIKKNLIGALLFDSGETAEATRLKRTARRRYTRRKNRICYLQEIFSN<br>EMAKVDDSFFHRLEESFLVEEDKKHERHPIFGNIVDEVAYHEKYPTIYHLR<br>KKLVDSTDKADLRLIYLALAHMIKFRGHFLIEGDLNPDNSDVDKLFIQLVQ<br>TYNQLFEENPINASGVDAKAILSARLSKSRRLENLIAQLPGEKKNGLFGNLI<br>ALSLGLTPNFKSNFDLAEDAKLQLSKDTYDDDLDNLLAQIGDQYADLFLA<br>AKNLSDAILLSDILRVNTEITKAPLSASMIKRYDEHHQDLTLLKALVRQQLP<br>EKYKEIFFDQSKNGYAGYIDGGASQEEFYKFIKPILEKMDGTEELLVKLNRE<br>DLLRKQRTFDNGSIPHQIHLGELHAILRRQEDFYPFLKDNREKIEKILTFRIPY<br>YVGPLARGNSRFAWMTRKSEETITPWNFEEVVDKGASAQSFIERMTNFDK<br>NLPNEKVLPKHSLLYEYFTVYNELTKVKYVTEGMRKPAFLSGEQKKAIVD<br>LLFKTNRKVTVKQLKEDYFKKIECFDSVEISGVEDRFNASLGTYHDLLKIIK<br>DKDFLDNEENEDILEDIVLTLTLFEDREMIEERLKTYAHLFDDKVMKQLKR<br>RRYTGWGRLSRKLINGIRDKQSGKTILDFLKSDGFANRNFMQLIHDDSLTF<br>KEDIQKAQVSGQGDSLHEHIANLAGSPAIKKGILQTVKVVDELVKVMGRH<br>KPENIVIEMARENQTTQKGQKNSRERMKRIEEGIKELGSQILKEHPVENTQL<br>QNEKLYLYYLQNGRDMYVDQELDINRLSDYDVDAIVPQSFLKDDSIDNKV<br>LTRSDKNRGKSDNVPSEEVVKKMKNYWRQLLNAKLITQRKFDNLTKAER<br>GGLSELDKAGFIKRQLVETRQITKHVAQILDSRMNTKYDENDKLIREVKVI<br>TLKSKLVSDFRKDFQFYKVREINNYHHAHDAYLNAVVGTALIKKYPKLES<br>EFVYGDYKVYDVRKMIAKSEQEIGKATAKYFFYSNIMNFFKTEITLANGEI<br>RKRPLIETNGETGEIVWDKGRDFATVRKVLSMPQVNIVKKTEVQTGGFSKE<br>SILPKRNSDKLIARKKDWDPKKYGGFDSPTVAYSVLVVAKVEKGKSKKLK<br>SVKELLGITIMERSSFEKNPIDFLEAKGYKEVKKDLIIKLPKYSLFELENGRK<br>RMLASAGELQKGNELALPSKYVNFLYLASHYEKLKGSPEDNEQKQLFVEQ<br>HKHYLDEIIEQISEFSKRVILADANLDKVLSAYNKHRDKPIREQAENIIHLFT<br>LTNLGAPAAFKYFDTTIDRKRYTSTKEVLDATLIHQSITGLYETRIDLSQLG<br>GDKRPAATKKAGQAKKKKASDAKSLTAWSRTLVTFKDVFVDFTREEWKL<br>LDTAQQILYRNVMLENYKNLVSLGYQLTKPDVILRLEKGEEPWLVEREIHQ<br>ETHPDSETAFEIKSSVPKKKRKV | NLS2-dSpCas9-<br>NLS-KRAB-NLS2<br>(AA) |
| 596 | MKRNYILGLDIGITSVGYGIIDYETRDVIDAGVRLFKEANVENNEGRRSKRG<br>ARRLKRRRHRIQRVKKLLFDYNLLTDHSELSGINPYEARVKGLSQKLSEE<br>EFSAALLHLAKRRGVHNVEVEEDTGNELSTKEQISRNSKALEEKYVAELQ<br>LERLKKDGEVRGSINRFKTSDYVKEAKQLLKVQKAYHQLDQSFIDTYIDLL<br>ETRRTYYEGPGEGSPFGWKDIKEWYEMLMGHCTYFPEELRSVKYAYNAD<br>LYNALNDLNNLVITRDENEKLEYYEKFQIIENVFKQKKKPTLKQIAKEILVN<br>EEDIKGYRVTSTGKPEFTNLKVYHDIKDITARKEIIENAELLDQIAKILTIYQS<br>SEDIQEELTNLNSELTQEEIEQISNLKGYTGTHNLSLKAINLILDELWHTNDN<br>QIAIFNRLKLVPKKVDLSQQKEIPTTLVDDFILSPVVKRSFIQSIKVINAIIKKY<br>GLPNDIIIELAREKNSKDAQKMINEMQKRNRQTNERIEEIIRTTGKENAKYLI<br>EKIKLHDMQEGKCLYSLEAIPLEDLLNNPFNYEVDHIIPRSVSFDNSFNNKV<br>LVKQEENSKKGNRTPFQYLSSSDSKISYETFKKHILNLAKGKGRISKTKKEY<br>LLEERDINRFSVQKDFINRNLVDTRYATRGLMNLLRSYFRVNNLDVKVKSI<br>NGGFTSFLRRKWKFKKERNKGYKHHAEDALIIANADFIPKEWKKLDKAKK<br>VMENQMFEEKQAESMPEIETEQEYKEIFITPHQIKHIKDFKDYKYSHRVDK<br>KPNRELINDTLYSTRKDDKGNTLIVNNLNGLYDKDNDKLKKLINKSPEKLL<br>MYHHDPQTYQKLKLIMEQYGDEKNPLYKYYEETGNYLTKYSKKDNGPVI | SaCas9 (AA)<br>dSaCas9 (AA) |

-continued

Sequences

| SEQ ID NO | Sequence | Description |
|---|---|---|
| | KKIKYYGNKLNAHLDITDDYPNSRNKVVKLSLKPYRFDVYLDNGVYKFVT VKNLDVIKKENYYEVNSKCYEEAKKLKKISNQAEFIASFYNNDLIKINGEL YRVIGVNNDLLNRIEVNMIDITYREYLENMNDKRPPRIIKTIASKTQSIKKYS TDILGNLYEVSKKHPQIIKKG | |
| 597 | KRNYILGLAIGITSVGYGIIDYETRDVIDAGVRLFKEANVENNEGRRSKRGA RRLKRRRHRIQRVKKLLFDYNLLTDHSELSGINPYEARVKGLSQKLSEEEF SAALLHLAKRRGVHNVNEVEEDTGNELSTKEQISRNSKALEEKYVAELQL ERLKKDGEVRGSINRFKTSDYVKEAKQLLKVQKAYHQLDQSFIDTYIDLLE TRRTYYEGPGEGSPFGWKDIKEWYEMLMGHCTYFPEELRSVKYAYNADL YNALNDLNNLVITRDENEKLEYYEKFQIIENVFKQKKKPTLKQIAKEILVNE EDIKGYRVTSTGKPEFTNLKVYHDIKDITARKEIIENAELLDQIAKILTIYQSS EDIQEELTNLNSELTQEEIEQISNLKGYTGTHNLSLKAINLILDELWHTNDN QIAIFNRLKLVPKKVDLSQQKEIPTTLVDDFILSPVVKRSFIQSIKVINAIIKKY GLPNDIIIELAREKNSKDAQKMINEMQKRNRQTNERIEEIIRTTGKENAKYLI EKIKLHDMQEGKCLYSLEAIPLEDLLNNPFNYEVDHIIPRSVSFDNSFNNKV LVKQEEASKKGNRTPFQYLSSSDSKISYETFKKHILNLAKGKGRISKTKKEY LLEERDINRFSVQKDFINRNLVDTRYATRGLMNLLRSYFRVNNLDVKVKSI NGGFTSFLRRKWKFKKERNKGYKHHAEDALIIANADFIFKEWKKLDKAKK VMENQMFEEKQAESMPEIETEQEYKEIFITPHQIKHIKDFKDYKYSHRVDK KPNRELINDTLYSTRKDDKGNTLIVNNLNGLYDKDNDKLKKLINKSPEKLL MYHHDPQTYQKLKLIMEQYGDEKNPLYKYYEETGNYLTKYSKKDNGPVI KKIKYYGNKLNAHLDITDDYPNSRNKVVKLSLKPYRFDVYLDNGVYKFVT VKNLDVIKKENYYEVNSKCYEEAKKLKKISNQAEFIASFYNNDLIKINGEL YRVIGVNNDLLNRIEVNMIDITYREYLENMNDKRPPRIIKTIASKTQSIKKYS TDILGNLYEVSKKHPQIIKKG | |
| 598 | MDKKYSIGLDIGTNSVGWAVITDEYKVPSKKFKVLGNTDRHSIKKNLIGAL LFDSGETAEATRLKRTARRRYTRRKNRICYLQEIFSNEMAKVDDSFFHRLE ESFLVEEDKKHERHPIFGNIVDEVAYHEKYPTIYHLRKKLVDSTDKADLRLI YLALAHMIKFRGHFLIEGDLNPDNSDVDKLFIQLVQTYNQLFEENPINASGV DAKAILSARLSKSRRLENLIAQLPGEKKNGLFGNLIALSLGLTPNFKSNFDL AEDAKLQLSKDTYDDDLDNLLAQIGDQYADLFLAAKNLSDAILLSDILRVN TEITKAPLSASMIKRYDEHHQDLTLLKALVRQQLPEKYKEIFFDQSKNGYA GYIDGGASQEEFYKFIKPILEKMDGTEELLVKLNREDLLRKQRTFDNGSIPH QIHLGELHAILRRQEDFYPFLKDNREKIEKILTFRIPYYVGPLARGNSRFAW MTRKSEETITPWNFEEVVDKGASAQSFIERMTNFDKNLPNEKVLPKHSLLY EYFTVYNELTKVKYVTEGMRKPAFLSGEQKKAIVDLLFKTNRKVTVKQLK EDYFKKIECFDSVEISGVEDRFNASLGTYHDLLKIIKDKDFLDNEENEDILED IVLTLTLFEDREMIEERLKTYAHLFDDKVMKQLKRRRYTGWGRLSRKLING IRDKQSGKTILDFLKSDGFANRNFMQLIHDDSLTFKEDIQKAQVSGQGDSL HEHIANLAGSPAIKKGILQTVKVVDELVKVMGRHKPENIVIEMARENQTTQ KGQKNSRERMKRIEEGIKELGSQILKEHPVENTQLQNEKLYLYYLQNGRD MYVDQELDINRLSDYDVDHIVPQSFLKDDSIDNKVLTRSDKNRGKSDNVPS EEVVKKMKNYWRQLLNAKLITQRKFDNLTKAERGGLSELDKAGFIKRQLV ETRQITKHVAQILDSRMNTKYDENDKLIREVKVITLKSKLVSDFRKDFQFY KVREINNYHHAHDAYLNAVVGTALIKKYPKLESEFVYGDYKVYDVRKMI AKSEQEIGKATAKYFFYSNIMNFFKTEITLANGEIRKRPLIETNGETGEIVWD KGRDFATVRKVLSMPQVNIVKKTEVQTGGFSKESILPKRNSDKLIARKKD WDPKKYGGFDSPTVAYSVLVVAKVEKGKSKKLKSVKELLGITIMERSSFE KNPIDFLEAKGYKEVKKDLIIKLPKYSLFELENGRKRMLASAGELQKGNEL ALPSKYVNFLYLASHYEKLKGSPEDNEQKQLFVEQHKHYLDEIIEQISEFSK RVILADANLDKVLSAYNKHRDKPIREQAENIIHLFTLTNLGAPAAFKYFDTT IDRKRYTSTKEVLDATLIHQSITGLYETRIDLSQLGGD | SpCas9 (AA) |
| 599 | DKKYSIGLAIGTNSVGWAVITDEYKVPSKKFKVLGNTDRHSIKKNLIGALL FDSGETAEAATRLKRTARRRYTRRKNRICYLQEIFSNEMAKVDDSFFHRLEE SFLVEEDKKHERHPIFGNIVDEVAYHEKYPTIYHLRKKLVDSTDKADLRLIY LALAHMIKFRGHFLIEGDLNPDNSDVDKLFIQLVQTYNQLFEENPINASGVD AKAILSARLSKSRRLENLIAQLPGEKKNGLFGNLIALSLGLTPNFKSNFDLA EDAKLQLSKDTYDDDLDNLLAQIGDQYADLFLAAKNLSDAILLSDILRVNT EITKAPLSASMIKRYDEHHQDLTLLKALVRQQLPEKYKEIFFDQSKNGYAG YIDGGASQEEFYKFIKPILEKMDGTEELLVKLNREDLLRKQRTFDNGSIPHQ IHLGELHAILRRQEDFYPFLKDNREKIEKILTFRIPYYVGPLARGNSRFAWM TRKSEETITPWNFEEVVDKGASAQSFIERMTNFDKNLPNEKVLPKHSLLYE YFTVYNELTKVKYVTEGMRKPAFLSGEQKKAIVDLLFKTNRKVTVKQLKE DYFKKIECFDSVEISGVEDRFNASLGTYHDLLKIIKDKDFLDNEENEDILEDI VLTLTLFEDREMIEERLKTYAHLFDDKVMKQLKRRRYTGWGRLSRKLINGI RDKQSGKTILDFLKSDGFANRNFMQLIHDDSLTFKEDIQKAQVSGQGDSLH EHIANLAGSPAIKKGILQTVKVVDELVKVMGRHKPENIVIEMARENQTTQK GQKNSRERMKRIEEGIKELGSQILKEHPVENTQLQNEKLYLYYLQNGRDM YVDQELDINRLSDYDVDAIVPQSFLKDDSIDNKVLTRSDKNRGKSDNVPSE EVVKKMKNYWRQLLNAKLITQRKFDNLTKAERGGLSELDKAGFIKRQLVE TRQITKHVAQILDSRMNTKYDENDKLIREVKVITLKSKLVSDFRKDFQFYK | dSpCas9 (AA) |

| SEQ ID NO | Sequence | Description |
|---|---|---|
|  | VREINNYHHAHDAYLNAVVGTALIKKYPKLESEFVYGDYKVYDVRKMIA KSEQEIGKATAKYFFYSNIMNFFKTEITLANGEIRKRPLIETNGETGEIVWDK GRDFATVRKVLSMPQVNIVKKTEVQTGGFSKESILPKRNSDKLIARKKDW DPKKYGGFDSPTVAYSVLVVAKVEKGKSKKLKSVKELLGITIMERSSFEKN PIDFLEAKGYKEVKKDLIIKLPKYSLFELENGRKRMLASAGELQKGNELAL PSKYVNFLYLASHYEKLKGSPEDNEQKQLFVEQHKHYLDEIIEQISEFSKRV ILADANLDKVLSAYNKHRDKPIREQAENIIHLFTLTNLGAPAAFKYFDTTID RKRYTSTKEVLDATLIHQSITGLYETRIDLSQLGGD |  |
| 600 | MKTPADTGFAFPDWAYKPESSPGSRQIQLWHFILELLRKEEYQGVIAWQG DYGEFVIKDPDEVARLWGVRKCKPQMNYDKLSRALRYYYNKRILHKTKG KRFTYKFNFNKLVLVNYPPIDVGLAGGAVPQSAPPVPSGGSHFRFPPSTPSE VLSPTEDPRSPPACSSSSSSLFSAVVARRLGRGSVSDCSDGTSELEEPLGEDP RARPPGPPDLGAFRGPPLARLPHDPGVFRVYPRPRGGPEPLSPFPVSPLAGP GSLLPPQLSPALPMTPTHLAYTPSPTLSPMYPSGGGPSGSGGGSHFSFSPED MKRYLQAHTQSVYNYHLSPRAFLHYPGLVVPQPQRPDKCPLPPMAPETPP VPSSASSSSSSSSPFKFKLQPPPLGRRQRAAGEKAVAGADKSGGSAGGLAE GAGAGALAPPPPPPQIKVEPISEGESEEVEVTDISDEDEEDGEVFKTPRAPPAPP KPEPGEAPGASQCMPLKRFKRRWSEDCRLEGGGGPAGGFEDEGEDKKVR GEGPGEAGGPLTPRRVSSDLQHATAQLSLEHRDS | ERF domain (AA) |
| 601 | MERVKMINVQRLLEAAEFLERRERECEHGYASSFPSMPSPRLQHSKPPRRL SRAQKHSSGSSNTSTANRSTHNELEKNRRAHLRLCLERLKVLIPLGPDCTR HTTLGLLNKAKAHIKKLEEAERKSQHQLENLEREQRFLKWRLEQLQGPQE MERIRMDSIGSTISSDRSDSEREEIEVDVESTEFSHGEVDNISTTSISDIDDHSS LPSIGSDEGYSSASVKLSFTS | MXI1 domain (AA) |
| 602 | ASPKKKRKVEASGSGMNIQMLLEAADYLERREREAEHGYASMLPGSGMNI QMLLEAADYLERREREAEHGYASMLPGSGMNIQMLLEAADYLERREREA EHGYASMLPGSGMNIQMLLEAADYLERREREAEHGYASMLPSRSR | SID4X domain (AA) |
| 603 | MAAAVRMNIQMLLEAADYLERREREAEHGYASMLPYNNKDRDALKRRN KSKKNNSSSRST HNEMEKNRRAHLRLCLEKLKGLVPLGPESSRHTTLSLLTKAKLHIKKLEDC DRKAVHQID QLQREQRHLKRQLEKLGIERIRMDSIGSTVSSERSDSDREEIDVDVESTDYL TGDLDWSS SSVSDSDERGSMQSLGSDEGYSSTSIKRIKLQDSHKACLG | MAD-SID domain (AA) |
| 604 | MPAMPSSGPGDTSSSAAEREEDRKDGEEQEEPRGKEERQEPSTTARKVGRP GRKRKHPPVESGDTPKDPAVISKSPSMAQDSGASELLPNGDLEKRSEPQPEE GSPAGGQKGGAPAEGEGAAETLPEASRAVENGCCTPKEGRGAPAEAGKEQ KETNIESMKMEGSRGRLRGGLGWESSLRQRPMPRLTFQAGDPYYISKRKR DEWLARWKREAEKKAKVIAGMNAVEENQGPGESQKVEEASPPAVQQPTD PASPTVATTPEPVGSDAGDKNATKAGDDEPEYEDGRGFGIGELVWGKLRG FSWWPGRIVSWWMTGRSRAAEGTRWVMWFGDGKFSVVCVEKLMPLSSF CSAFHQATYNKQPMYRKAIYEVLQVASSRAGKLFPVCHDSDESDTAKAVE VQNKPMIEWALGGFQPSGPKGLEPPEEEKNPYKEVYTDMWVEPEAAAYA PPPPAKKPRKSTAEKPKVKEIIDERTRERLVYEVRQKCRNIEDICISCGSLNV TLEHPLFVGGMCQNCKNCFLECAYQYDDDGYQSYCTICCGGREVLMCGN NNCCRCFCVECVDLLVGPGAAQAAIKEDPWNCYCMCGHKGTYGLLRRRED WPSRLQMFFANNHDQEFDPPKVYPPVPAEKRKPIRVLSLFDGIATGLLVLK DLGIQVDRYIASEVCEDSITVGMVRHQGKIMYVGDVRSVTQKHIQEWGPF DLVIGGSPCNDLSIVNPARKGLYEGTGRLFFEFYRLLHDARPKEGDDRPFF WLFENVVAMGVSDKRDISRFLESNPVMIDAKEVSAAHRARYFWGNLPGM NRPLASTVNDKLELQECLEHGRIAKFSKVRTITTRSNSIKQGKDQHFPVFMN EKEDILWCTEMERVFGFPVHYTDVSNMSRLARQRLLGRSWSVPVIRHLFAP LKEYFA | DNMT3A (AA) |
| 605 | MKGDTRHLNGEEDAGGREDSILVNGACSDQSSDSPPILEAIRTPEIRGRRSSS RLSKREVSSLLSYTQDLTGDGDGEDGDGSDTPVMPKLFRETRTRSESPAVR TRNNNSVSSRERHRPSPRSTRGRQGRNHVDESPVEFPATRSLRRRATASAG TPWPSPPSSYLTIDLTDDTEDTHGTPQSSSTPYARLAQDSQQGGMESPVEA DSGDGDSSEYQDGKEFGIGDLVWGKIKGFSWWPAMVVSWKATSKRQAM SGMRWVQWFGDGKFSEVSADKLVALGLFSQHFNLATFNKLVSYRKAMY HALEKARVRAGKTFPSSPGDSLEDQLKPMLEWAHGGFKPTGIEGLKPNNT QPVVNKSKVRRAGSRKLESRKYENKTRRRTADDSATSDYCPAPKRLKTNC YNNGKDRGDEDQSREQMASDVANNKSSLEDGCLSCGRKNPVSFHPLFEGG LCQTCRDRFLELFYMYDDDGYQSYCTVCCEGRELLLCSNTSCCRCFCVEC LEVLVGTGTAAEAKLQEPWSCYMCLPQRCHGVLRRRKDWNVRLQAFFTS DTGLEYEAPKLYPAIPAARRRPIRVLSLFDGIATGYLVLKELGIKVGKYVAS EVCEESIAVGTVKHEGNIKYVNDVRNITKKNIEEWGPFDLVIGGSPCNDLSN VNPARKGLYEGTGRLFFEFYHLLNYSRPKEGDDRPFFWMFENVVAMKVG DKRDISRFLECNPVMIDAIKVSAAHRARYFWGNLPGMNRPVIASKNDKLEL | DNMT3B (AA) |

| SEQ ID NO | Sequence | Description |
|---|---|---|
| | QDCLEYNRIAKLKKVQTITTKSNSIKQGKNQLFPVVMNGKEDVLWCTELE<br>RIFGFPVHYTDVSNMGRGARQKLLGRSWSVPVIRHLFAPLKDYFACE | |
| 606 | MLSGKKAAAAAAAAAAAATGTEAGPGTAGGSENGSEVAAQPAGLSGPAE<br>VGPGAVGERTPRKKEPPRASPPGGLAEPPGSAGPQAGPTVVPGSATPMETG<br>IAETPEGRRTSRRKRAKVEYREMDESLANLSEDEYYSEEERNAKAEKEKKL<br>PPPPPQAPPEEENESEPEEPSGVEGAAFQSRLPHDRMTSQEAACFPDIISGPQ<br>QTQKVFLFIRNRTLQLWLDNPKIQLTFEATLQQLEAPYNSDTVLVHRVHSY<br>LERHGLINFGIYKRIKPLPTKKTGKVIIIGSGVSGLAAARQLQSFGMDVTLLE<br>ARDRVGGRVATFRKGNYVADLGAMVVTGLGGNPMAVVSKQVNMELAKI<br>KQKCPLYEANGQAVPKEKDEMVEQEFNRLLEATSYLSHQLDFNVLNNKPV<br>SLGQALEVVIQLQEKHVKDEQIEHWKKIVKTQEELKELLNKMVNLKEKIK<br>ELHQQYKEASEVKPPRDITAEFLVKSKHRDLTALCKEYDELAETQGKLEEK<br>LQELEANPPSDVYLSSRDRQILDWHFANLEFANATPLSTLSLKHWDQDDDF<br>EFTGSHLTVRNGYSCVPVALAEGLDIKLNTAVRQVRYTASGCEVIAVNTRS<br>TSQTFIYKCDAVLCTLPLGVLKQQPPAVQFVPPLPEWKTSAVQRMGFGNL<br>NKVVLCFDRVFWDPSVNLFGHVGSTTASRGELFLFWNLYKAPILLALVAG<br>EAAGIMENISDDVIVGRCLAILKGIFGSSAVPQPKETVVSRWRADPWARGS<br>YSYVAAGSSGNDYDLMAQPITPGPSIPGAPQPIPRLFFAGEHTIRNYPATVH<br>GALLSGLREAGRIADQFLGAMYTLPRQATPGVPAQQSPSM | LSD1 (AA) |
| 607 | MAAIPALDPEAEPSMDVILVGSSELSSSVSPGTGRDLIAYEVKANQRNIEDIC<br>ICCGSLQVHTQHPLFEGGICAPCKDKFLDALFLYDDDGYQSYCSICSGETLL<br>ICGNPDCTRCYCFECVDSLVGPGTSGKVHAMSNWVCYLCLPSSSGLLQRR<br>RKWRSQLKAFYDRESENPLEMFETVPVWRRQPVRVLSLFEDIKKELTSLGF<br>LESGSDPGQLKHVVDVTDTVRKDVEEWGPFDLVYGATPPLGHTCDRPPSW<br>YLFQFHRLLQYARPKPGSPRPFFWMFVDNLVLNKEDLDVASRFLEMEPVTI<br>PDVHGGSLQNAVRVWSNIPAIRSRHWALVSEEELSLLAQNKQSSKLAAKW<br>PTKLVKNCFLPLREYFKYFSTELTSSL | DNMT3L (AA) |
| 608 | MGQTGKKSEKGPVCWRKRVKSEYMRLRQLKRFRRADEVKTMFSSNRQKI<br>LERTETLNQEWKQRRIQPVHIMTSVSSLRGTRECSVTSDLDFPAQVIPLKTL<br>NAVASVPIMYSWSPLQQNFMVEDETVLHNIPYMGDEVLQDGTFIEELIKN<br>YDGKVHGDRECGFINDEIFVELVNALGQYNDDDDDDGDDPEREEKQK<br>DLEDNRDDKETCPPRKFPADKIFEAISSMFPDKGTAEELKEKYKELTEQQLP<br>GALPPECTPNIDGPNAKSVQREQSLHSFHTLFCRRCFKYDCFLHPFHATPNT<br>YKRKNTETALDNKPCGPQCYQHLEGAKEFAAALTAERIKTPPKRPGGRRR<br>GRLPNNSSRPSTPTISVLESKDTSDREAGTETGGENNDKEEEEKKDETSSS<br>SEANSRCQTPIKMKPNIEPPENVEWSGAEASMFRVLIGTYYDNFCAIARLIG<br>TKTCRQVYEFRVKESSIIAPVPTEDVDTPPRKKKRKHRLWAAHCRKIQLKK<br>DGSSNHVYNYQPCDHPRQPCDSSCPCVIAQNFCEKFCQCSSECQNRFPGCR<br>CKAQCNTKQCPCYLAVRECDPDLCLTCGAADHWDSKNVSCKNCSIQRGS<br>KKHLLLAPSDVAGWGIFIKDPVQKNEFISEYCGEIISQDEADRRGKVYDKY<br>MCSFLFNLNNDFVVDATRKGNKIRFANHSVNPNCYAKVMMVNGDHRIGIF<br>AKRAIQTGEELFFDYRYSQADALKYVGIEREMEIP | EZH2 (AA) |
| 609 | GGGGS | GGGGS linker (AA) |
| 610 | GGGGG | GGGGG linker (AA) |
| 611 | GGAGG | GGAGG linker (AA) |
| 612 | GGGGSSS | GGGGSSS linker (AA) |
| 613 | GGGGAAA | GGGGAAA linker (AA) |
| 614 | PKKKRKV | NLS-SV40 (AA) |
| 615 | PAAKRVKLD | NLS-cMyc (AA) |
| 616 | RQRRNELKRSP | NLS-cMyc (AA) |
| 617 | NQSSNFGPMKGGNFGGRSSGPYGGGGQYFAKPRNQGGY | NLS-hRNPA1 M9 (AA) |
| 618 | RMRIZFKNKGKDTAELRRRVEVSVELRKAKKDEQILKRRNV | NLS-IBB domain importin-alpha (AA) |

-continued

Sequences

| SEQ ID NO | Sequence | Description |
|---|---|---|
| 619 | VSRKRPRP | NLS-myoma T protein (AA) |
| 620 | PPKKARED | NLS-myoma T protein (AA) |
| 621 | PQPKKKPL | NLS-human p53 (AA) |
| 622 | SALIKKKKKMAP | NLS-mouse c-abl IV (AA) |
| 623 | DRLRR | NLS-influenza NS1 (AA) |
| 624 | PKQKKRK | NLS-influenza NS1 (AA) |
| 625 | RKLKKKIKKL | NLS-hepatitis delta antigen (AA) |
| 626 | REKKKFLKRR | NLS-mouse Mx1 (AA) |
| 627 | KRKGDEVDGVDEVAKKKSKK | NLS-human poly(ADP-ribose) polymerase (AA) |
| 628 | RKCLQAGMNLEARKTKK | NLS-glucocorticoid (AA) |
| 629 | NGG | PAM-SpCas9 |
| 630 | NNGRRT | PAM-SaCas9 |
| 631 | NNNNGATT | PAM-*N. meningitidis* Cas9 |
| 632 | NNNNRYAC | PAM-*C. jejuni* Cas9 |
| 633 | NNAGAAW | PAM-*S. thermophilus* |
| 634 | NGG | PAM-*F. Novicida* |
| 635 | NAAAAC | PAM-*T. denticola* |
| 636 | TTTV | PAM-Cas12a/Cpf1 |
| 637 | NGAN | Variant PAM-SpCas9 variant |
| 638 | NGNG | Variant PAM-SpCas9 variant |
| 639 | NGAG | Variant PAM-SpCas9 variant |
| 640 | NGCG | Variant PAM-SpCas9 variant |
| 641 | LLPKNYHLENEVARLKKLVGER | SunTag GCN4 peptide (AA) |
| 642 | GGSGG | Linker (AA) |
| 643 | GGPSSGAPPPSGGSPAGSPTSTEEGTSESATPESGPGTSTEPSEGSAPGSPAGSPTSTEEGTSTEPSEGSAPGTSTEPSE | XTEN80 (aa) |

| SEQ ID NO | Sequence | Description |
|---|---|---|
| 644 | ATGGACTACAAAGACCATGACGGTGATTATAAAGATCATGACATCGAT<br>TACAAGGATGACGATGACAAGCACGTTAACCACGATCAGGAGTTTGAC<br>CCCCCTAAGGTGTACCCACCCGTGCCAGCCGAGAAGAGGAAGCCCATC<br>CGCGTGCTGTCCCTGTTCGACGGCATCGCCACAGGCCTGCTGGTGCTGA<br>AGGATCTGGGCATCCAGGTGGACAGATATATCGCCTCCGAGGTGTGCG<br>AGGATTCTATCACCGTGGGCATGGTGAGGCACCAGGGCAAGATCATGT<br>ACGTGGGCGACGTGCGCAGCGTGACACAGAAGCACATCCAGGAGTGGG<br>GACCCTTCGACCTGGTCATCGGAGGCAGCCCCTGTAATGACCTGTCCAT<br>CGTGAACCCTGCAAGGAAGGGCCTGTATGAGGGAACCGGCAGACTGTT<br>CTTTGAGTTCTACAGGCTGCTGCACGACGCCCGCCCTAAGGAGGGCGAT<br>GACAGGCCATTCTTTTGGCTGTTTGAGAACGTGGTGGCCATGGGCGTGA<br>GCGACAAGCGGGATATCTCCAGATTCCTGGAGTCTAATCCCGTGATGAT<br>CGATGCAAAGGAGGTGTCTGCCGCACACAGGGCAAGGTACTTTTGGGG<br>AAATCTGCCTGGCATGAACCGCCCACTGGCCAGCACCGTGAACGACAA<br>GCTGGAGCTGCAGGAGTGCCTGGAGCACGGAAGGATCGCCAAGTTCTC<br>CAAGGTGCGGACAATCACCACAAGATCTAACAGCATCAAGCAGGGCAA<br>GGATCAGCACTTCCCCGTGTTCATGAATGAGAAGGAGGACATCCTGTGG<br>TGTACCGAGATGGAGCGCGTGTTCGGCTTTCCAGTGCACTATACAGACG<br>TGAGCAATATGAGCCGGCTGGCAAGGCAGAGACTGCTGGGCCGGTCCT<br>GGTCTGTGCCAGTGATCAGACACCTGTTCGCCCCCCTGAAGGAGTACTT<br>TGCCTGCGTGTCTAGCGGCAACTCTAATGCCAACAGCAGAGGCCCTTCC<br>TTTTCCTCTGGCCTGGTGCCACTGTCTCTGAGGGGCAGCCACATGGGCC<br>CCATGGAGATCTACAAGACCGTGTCCGCCTGGAAGAGGCAGCCTGTGC<br>GCGTGCTGTCTCTGTTCCGCAACATCGACAAGGTGCTGAAGAGCCTGGG<br>CTTTCTGGAGAGCGGATCCGGATCTGGAGGAGGCACCCTGAAGTATGT<br>GGAGGATGTGACAAATGTGGTGCGGAGAGATGTGGAGAAGTGGGGCCC<br>CTTCGATCTGGTGTACGGATCCACCCAGCCACTGGGAAGCTCCTGCGAT<br>AGGTGTCCAGGATGGTATATGTTCCAGTTTCACAGAATCCTGCAGTACG<br>CACTGCCAAGGCAGGAGAGCCAGCGCCCTTTCTTTTGGATCTTTATGGA<br>CAACCTGCTGCTGACAGAGGATGACCAGGAGACAACAACCCGCTTCCT<br>GCAGACAGAGGCAGTGACCCTGCAGGATGTGAGGGGACGCGACTATCA<br>GAATGCCATGCGGGTGTGGTCTAACATCCCTGGCCTGAAGAGCAAGCA<br>CGCCCCCCTGACCCCTAAGGAGGAGGAGTACCTGCAGGCCCAGGTGCG<br>GAGCAGATCCAAGCTGGATGCCCCTAAGGTGGACCTGCTGGTGAAGAA<br>TTGTCTGCTGCCACTGCGGGAGTACTTCAAGTACTTTAGTCAGAATAGC<br>CTGCCACTGgaggcaagcggatccggaagggcatctcctggaatcccaggaagcacccgcAACCCC<br>AAGAAGAAGCGGAAGGTGGGCATCCACGGCGTGCCCGCCGCCGACAAG<br>AAGTACAGCATCGGCCTGGCCATCGGCACCAACAGCGTGGGCTGGGCC<br>GTGATCACCGACGAGTACAAGGTGCCCAGCAAGAAGTTCAAGGTGCTG<br>GGCAACACCGACCGGCACAGCATCAAGAAGAACCTGATCGGCGCCCTG<br>CTGTTCGACAGCGGCGAGACCGCCGAGGCCACCCGGCTGAAGCGGACC<br>GCCCGGCGGCGGTACACCCGGCGGAAGAACCGGATCTGCTACCTGCAG<br>GAGATCTTCAGCAACGAGATGGCCAAGGTGGACGACAGCTTCTTCCAC<br>CGGCTGGAGGAGAGCTTCCTGGTGGAGGAGGACAAGAAGCACGAGCG<br>GCACCCCATCTTCGGCAACATCGTGGACGAGGTGGCCTACCACGAGAA<br>GTACCCCACCATCTACCACCTGCGGAAGAAGCTGGTGGACAGCACCGA<br>CAAGGCCGACCTGCGGCTGATCTACCTGGCCCTGGCCCACATGATCAAG<br>TTCCGGGGCCACTTCCTGATCGAGGGCGACCTGAACCCCGACAACAGC<br>GACGTGGACAAGCTGTTCATCCAGCTGGTGCAGACCTACAACCAGCTGT<br>TCGAGGAGAACCCCATCAACGCCAGCGGCGTGGACGCCAAGGCCATCC<br>TGAGCGCCCGGCTGAGCAAGAGCCGGCGGCTGGAGAACCTGATCGCCC<br>AGCTGCCCGGCGAGAAGAAGAACGGCCTGTTCGGCAACCTGATCGCCC<br>TGAGCCTGGGCCTGACCCCCAACTTCAAGAGCAACTTCGACCTGGCCGA<br>GGACGCCAAGCTGCAGCTGAGCAAGGACACCTACGACGACGACCTGGA<br>CAACCTGCTGGCCCAGATCGGCGACCAGTACGCCGACCTGTTCCTGGCC<br>GCCAAGAACCTGAGCGACGCCATCCTGCTGAGCGACATCCTGCGGGTG<br>AACACCGAGATCACCAAGGCCCCCCTGAGCGCCAGCATGATCAAGCGG<br>TACGACGAGCACCACCAGGACCTGACCCTGCTGAAGGCCCTGGTGCGG<br>CAGCAGCTGCCCGAGAAGTACAAGGAGATCTTCTTCGACCAGAGCAAG<br>AACGGCTACGCCGGCTACATCGACGGCGGCGCCAGCCAGGAGGAGTTC<br>TACAAGTTCATCAAGCCCATCCTGGAGAAGATGGACGGCACCGAGGAG<br>CTGCTGGTGAAGCTGAACCGGGAGGACCTGCTGCGGAAGCAGCGGACC<br>TTCGACAACGGCAGCATCCCCCACCAGATCCACCTGGGCGAGCTGCAC<br>GCCATCCTGCGGCGGCAGGAGGACTTCTACCCCTTCCTGAAGGACAACC<br>GGGAGAAGATCGAGAAGATCCTGACCTTCCGGATCCCCTACTACGTGG<br>GCCCCCTGGCCCGGGGCAACAGCCGGTTCGCCTGGATGACCCGGAAGA<br>GCGAGGAGACCATCACCCCCTGGAACTTCGAGGAGGTGGTGGACAAGG<br>GCGCCAGCGCCCAGAGCTTCATCGAGCGGATGACCAACTTCGACAAGA<br>ACCTGCCCAACGAGAAGGTGCTGCCCAAGCACAGCCTGCTGTACGAGT<br>ACTTCACCGTGTACAACGAGCTGACCAAGGTGAAGTACGTGACCGAGG<br>GCATGCGGAAGCCCGCCTTCCTGAGCGGCGAGCAGAAGAAGGCCATCG<br>TGGACCTGCTGTTCAAGACCAACCGGAAGGTGACCGTGAAGCAGCTGA<br>AGGAGGACTACTTCAAGAAGATCGAGTGCTTCGACAGCGTGGAGATCA<br>GCGGCGTGGAGGACCGGTTCAACGCCAGCCTGGGCACCTACCACGACC | DNMT3A/L-<br>dSpCas9-KRAB<br>(nt) |

-continued

Sequences

| SEQ ID NO | Sequence | Description |
|---|---|---|
| | TGCTGAAGATCATCAAGGACAAGGACTTCCTGGACAACGAGGAGAACG<br>AGGACATCCTGGAGGACATCGTGCTGACCCTGACCCTGTTCGAGGACCG<br>GGAGATGATCGAGGAGCGGCTGAAGACCTACGCCCACCTGTTCGACGA<br>CAAGGTGATGAAGCAGCTGAAGCGGCGGCGGTACACCGGCTGGGGCCG<br>GCTGAGCCGGAAGCTGATCAACGGCATCCGGGACAAGCAGAGCGGCAA<br>GACCATCCTGGACTTCCTGAAGAGCGACGGCTTCGCCAACCGGAACTTC<br>ATGCAGCTGATCCACGACGACGCCTGACCTTCAAGGAGGACATCCAG<br>AAGGCCCAGGTGAGCGGCCAGGGCGACAGCCTGCACGAGCACATCGCC<br>AACCTGGCCGGCAGCCCCGCCATCAAGAAGGGCATCCTGCAGACCGTG<br>AAGGTGGTGGACGAGCTGGTGAAGGTGATGGGCCGGCACAAGCCCGAG<br>AACATCGTGATCGAGATGGCCCGGGAGAACCAGACCACCCAGAAGGGC<br>CAGAAGAACAGCCGGGAGCGGATGAAGCGGATCGAGGAGGGCATCAA<br>GGAGCTGGGCAGCCAGATCCTGAAGGAGCACCCCGTGGAGAACACCCA<br>GCTGCAGAACGAGAAGCTGTACCTGTACTACCTGCAGAACGGCCGGGA<br>CATGTACGTGGACCAGGAGCTGGACATCAACCGGCTGAGCGACTACGA<br>CGTGGACGCCATCGTGCCCCAGAGCTTCCTGAAGGACGACAGCATCGA<br>CAACAAGGTGCTGACCCGGAGCGACAAGAACCGGGGCAAGAGCGACA<br>ACGTGCCCAGCGAGGAGGTGGTGAAGAAGATGAAGAACTACTGGCGGC<br>AGCTGCTGAACGCCAAGCTGATCACCCAGCGGAAGTTCGACAACCTGA<br>CCAAGGCCGAGCGGGGCGGCCTGAGCGAGCTGGACAAGGCCGGCTTCA<br>TCAAGCGGCAGCTGGTGGAGACCCGGCAGATCACCAAGCACGTGGCCC<br>AGATCCTGGACAGCCGGATGAACACCAAGTACGACGAGAACGACAAGC<br>TGATCCGGGAGGTGAAGGTGATCACCCTGAAGAGCAAGCTGGTGAGCG<br>ACTTCCGGAAGGACTTCCAGTTCTACAAGGTGCGGGAGATCAACAACT<br>ACCACCACGCCCACGACGCCTACCTGAACGCCGTGGTGGGCACCGCCCT<br>GATCAAGAAGTACCCCAAGCTGGAGAGCGAGTTCGTGTACGGCGACTA<br>CAAGGTGTACGACGTGCGGAAGATGATCGCCAAGAGCGAGCAGGAGAT<br>CGGCAAGGCCACCGCCAAGTACTTCTTCTACAGCAACATCATGAACTTC<br>TTCAAGACCGAGATCACCCTGGCCAACGGCGAGATCCGGAAGCGGCCC<br>CTGATCGAGACCAACGGCGAGACCGGCGAGATCGTGTGGGACAAGGGC<br>CGGGACTTCGCCACCGTGCGGAAGGTGCTGAGCATGCCCCAGGTGAAC<br>ATCGTGAAGAAGACCGAGGTGCAGACCGGCGGCTTCAGCAAGGAGAGC<br>ATCCTGCCCAAGCGGAACAGCGACAAGCTGATCGCCCGGAAGAAGGAC<br>TGGGACCCCAAGAAGTACGGCGGCTTCGACAGCCCCACCGTGGCCTAC<br>AGCGTGCTGGTGGTGGCCAAGGTGGAGAAGGGCAAGAGCAAGAAGCT<br>GAAGAGCGTGAAGGAGCTGCTGGGCATCACCATCATGGAGCGGAGCAG<br>CTTCGAGAAGAACCCCATCGACTTCCTGGAGGCCAAGGGCTACAAGGA<br>GGTGAAGAAGGACCTGATCATCAAGCTGCCCAAGTACAGCCTGTTCGA<br>GCTGGAGAACGGCCGGAAGCGGATGCTGGCCAGCGCCGGCGAGCTGCA<br>GAAGGGCAACGAGCTGGCCCTGCCCAGCAAGTACGTGAACTTCCTGTA<br>CCTGGCCAGCCACTACGAGAAGCTGAAGGGCAGCCCCGAGGACAACGA<br>GCAGAAGCAGCTGTTCGTGGAGCAGCACAAGCACTACCTGGACGAGAT<br>CATCGAGCAGATCAGCGAGTTCAGCAAGCGGGTGATCCTGGCCGACGC<br>CAACCTGGACAAGGTGCTGAGCGCCTACAACAAGCACCGGGACAAGCC<br>CATCCGGGAGCAGGCCGAGAACATCATCCACCTGTTCACCCTGACCAAC<br>CTGGGCGCCCCCGCCGCCTTCAAGTACTTCGACACCACCATCGACCGGA<br>AGCGGTACACCAGCACCAAGGAGGTGCTGGACGCCACCCTGATCCACC<br>AGAGCATCACCGGCCTGTACGAGACCCGGATCGACCTGAGCCAGCTGG<br>GCGGCGACAGCGGCGGCAAGCGGCCCGCCGCCACCAAGAAGGCCGGCC<br>AGGCCAAGAAGAAGAAGGCtagCgatgctaagtcactgactgcctggtcccggacactggtgacct<br>tcaaggatgtgtttgtggacttcaccagggaggagtggaagctgctggacactgctcagcagatcctg<br>tacagaaatgtgatgctggagaactataagaacctggtttccttgggttatcagcttactaagccaga<br>tgtgatcctccggttggagaagggagaagagccctggctggtggagagagaaattcaccaagagaccc<br>atcctgattcagagactgcatttgaaatcaaatcatcagttCCGAAAAAGAAACGCAAAGTT | |
| 645 | MDYKDHDGDYKDHDIDYKDDDDKHVNHDQEFDPPKVYPPVPAEKRK<br>PIRVLSLFDGIATGLLVLKDLGIQVDRYIASEVCEDSITVGMVRHQGKIMYV<br>GDVRSVTQKHIQEWGPFDLVIGGSPCNDLSIVNPARKGLYEGTGRLFFEFY<br>RLLHDARPKEGDDRPFFWLFENVVAMGVSDKRDISRFLESNPVMIDAKEV<br>SAAHRARYFWGNLPGMNRPLASTVNDKLELQECLEHGRIAKFSKVRTITTR<br>SNSIKQGKDQHFPVFMNEKEDILWCTEMERVFGPVHYTDVSNMSRLARQ<br>RLLGRSWSVPVIRHLFAPLKEYFACVSSGNSNANSRGPSFSSGLVPLSLRGS<br>HMGPMEIYKTVSAWKRQPVRVLSLFRNIDKVLKSLGFLESGSGSGGGTLK<br>YVEDVTNVVRRDVEKWGPFDLVYGSTQPLGSSCDRCPGWYMFQFHRILQ<br>YALPRQESQRPFFWIFMDNLLLTEDDQETTTRFLQTEAVTLQDVRGRDYQ<br>NAMRVWSNIPGLKSKHAPLTPKEEEYLQAQVRSRSKLDAPKVDLLVKNCL<br>LPLREYFKYFSQNSLPLEASGSGRASPGIPGSTRNPKKKRKVGIHGVPAADK<br>KYSIGLAIGTNSVGWAVITDEYKVPSKKFKVLGNTDRHSIKKNLIGALLFDS<br>GETAEATRLKRTARRRYTRRKNRICYLQEIFSNEMAKVDDSFFHRLEESFL<br>VEEDKKHERHPIFGNIVDEVAYHEKYPTIYHLRKKLVDSTDKADLRLIYLA<br>LAHMIKFRGHFLIEGDLNPDNSDVDKLFIQLVQTYNQLFEENPINASGVDA<br>KAILSARLSKSRRLENLIAQLPGEKKNGLFGNLIALSLGLTPNFKSNFDLAE<br>DAKLQLSKDTYDDDLDNLLAQIGDQYADLFLAAKNLSDAILLSDILRVNTE<br>ITKAPLSASMIKRYDEHHQDLTLLKALVRQQLPEKYKEIFFDQSKNGYAGY | DNMT3A/L-<br>dSpCas9-<br>KRAB (AA) |

| SEQ ID NO | Sequence | Description |
|---|---|---|
| | IDGGASQEEFYKFIKPILEKMDGTEELLVKLNREDLLRKQRTFDNGSIPHQI<br>HLGELHAILRRQEDFYPFLKDNREKIEKILTFRIPYYVGPLARGNSRFAWMT<br>RKSEETITPWNFEEVVDKGASAQSFIERMTNFDKNLPNEKVLPKHSLLYEY<br>FTVYNELTKVKYVTEGMRKPAFLSGEQKKAIVDLLFKTNRKVTVKQLKED<br>YFKKIECFDSVEISGVEDRFNASLGTYHDLLKIIKDKDFLDNEENEDILEDIV<br>LTLTLFEDREMIEERLKTYAHLFDDKVMKQLKRRRYTGWGRLSRKLINGIR<br>DKQSGKTILDFLKSDGFANRNFMQLIHDDSLTFKEDIQKAQVSGQGDSLHE<br>HIANLAGSPAIKKGILQTVKVVDELVKVMGRHKPENIVIEMARENQTTQKG<br>QKNSRERMKRIEEGIKELGSQILKEHPVENTQLQNEKLYLYYLQNGRDMY<br>VDQELDINRLSDYDVDAIVPQSFLKDDSIDNKVLTRSDKNRGKSDNVPSEE<br>VVKKMKNYWRQLLNAKLITQRKFDNLTKAERGGLSELDKAGFIKRQLVET<br>RQITKHVAQILDSRMNTKYDENDKLIREVKVITLKSKLVSDFRKDFQFYKV<br>REINNYHHAHDAYLNAVVGTALIKKYPKLESEFVYGDYKVYDVRKMIAKS<br>EQEIGKATAKYFFYSNIMNFFKTEITLANGEIRKRPLIETNGETGEIVWDKG<br>RDFATVRKVLSMPQVNIVKKTEVQTGGFSKESILPKRNSDKLIARKKDWDP<br>KKYGGFDSPTVAYSVLVVAKVEKGKSKKLKSVKELLGITIMERSSFEKNPI<br>DFLEAKGYKEVKKDLIIKLPKYSLFELENGRKRMLASAGELQKGNELALPS<br>KYVNFLYLASHYEKLKGSPEDNEQKQLFVEQHKHYLDEIIEQISEFSKRVIL<br>ADANLDKVLSAYNKHRDKPIREQAENIIHLFTLTNLGAPAAFKYFDTTIDR<br>KRYTSTKEVLDATLIHQSITGLYETRIDLSQLGGDSGGKRPAATKKAGQAK<br>KKKASDAKSLTAWSRTLVTFKDVPVDFTREEWKLLDTAQQILYRNVMLE<br>NYKNLVSLGYQLTKPDVILRLEKGEEPWLVEREIHQETHPDSETAFEIKSSV<br>PKKKRKV | |
| 646 | ATGAACCACGATCAGGAGTTTGACCCCCCTAAGGTGTACCCACCCGTGC<br>CAGCCGAGAAGAGGAAGCCCATCCGCGTGCGTCCCTGTTCGACGGCA<br>TCGCCACAGGCCTGCTGGTGCTGAAGGATCTGGGCATCCAGGTGGACA<br>GATATATCGCCTCCGAGGTGTGCGAGGATTCTATCACCGTGGGCATGGT<br>GAGGCACCAGGGCAAGATCATGTACGTGGGCGACGTGCGCAGCGTGAC<br>ACAGAAGCACATCCAGGAGTGGGGACCCTTCGACCTGGTCATCGGAGG<br>CAGCCCCTGTAATGACCTGTCCATCGTGAACCCTGCAAGGAAGGGCCTG<br>TATGAGGGAACCGGCAGACTGTTCTTTGAGTTCTACAGGCTGCTGCACG<br>ACGCCCGCCCTAAGGAGGGCGATGACAGGCCATTCTTTTGGCTGTTTGA<br>GAACGTGGTGGCCATGGGCGTGAGCGACAAGCGGGATATCTCCAGATT<br>CCTGGAGTCTAATCCCGTGATGATCGATGCAAAGGAGGTGTCTGCCGCA<br>CACAGGGCAAGGTACTTTTGGGGAAATCTGCCTGGCATGAACCGCCCA<br>CTGGCCAGCACCGTGAACGACAAGCTGGAGCTGCAGGAGTGCCTGGAG<br>CACGGAAGGATCGCCAAGTTCTCCAAGGTGCGGACAATCACCACAAGA<br>TCTAACAGCATCAAGCAGGGCAAGGATCAGCACTTCCCCGTGTTCATGA<br>ATGAGAAGGAGGACATCCTGTGGTGTACCGAGATGGACGCGTGTTCG<br>GCTTTCCAGTGCACTATACAGACGTGAGCAATATGAGCCGGCTGGCAA<br>GGCAGAGACTGCTGGGCCGGTCCTGGTCTGTGCCAGTGATCAGACACCT<br>GTTCGCCCCCCTGAAGGAGTACTTTGCCTGCGTGTCTAGCGGCAACTCT<br>AATGCCAACAGCAGAGGCCCTTCCTTTTCCTCTGGCCTGGTGCCACTGT<br>CTCTGAGGGGCAGCCACATGGGCCCCATGGAGATCTACAAGACCGTGT<br>CCGCCTGGAAGAGGCAGCCTGTGCGCGTGCTGTCTCTGTTCCGCAACAT<br>CGACAAGGTGCTGAAGAGCCTGGGCTTTCTGGAGAGCGGATCCGGATC<br>TGGAGGAGGCACCCTGAAGTATGTGGAGGATGTGACAAATGTGGTGCG<br>GAGAGATGTGGAGAAGTGGGGCCCCTTCGATCTGGTGTACGGATCCAC<br>CCAGCCACTGGGAAGCTCCTGCGATAGGTGTCCAGGATGGTATATGTTC<br>CAGTTTCACAGAATCCTGCAGTACGCACTGCCAAGGCAGGAGAGCCAG<br>CGCCCTTTCTTTTGGATCTTTATGGACAACCTGCTGCTGACAGAGGATG<br>ACCAGGAGACAACAACCCGCTTCCTGCAGACAGAGGCAGTGACCCTGC<br>AGGATGTGAGGGGACGCGACTATCAGAATGCCATGCGGGTGTGGTCTA<br>ACATCCCTGGCCTGAAGAGCAAGCACGCCCCCCTGACCCCTAAGGAGG<br>AGGAGTACCTGCAGGCCCAGGTGCGGAGCAGATCCAAGCTGGATGCCC<br>CTAAGGTGGACCTGCTGGTGAAGAATTGTCTGCTGCCACTGCGGGAGTA<br>CTTCAAGTACTTTAGTCAGAATAGCCTGCCACTGGGAGGGCCGAGTCT<br>GGCGCACCCCCACCAAGTGGAGGGTCTCCTGCCGGGTCCCCAACATCTA<br>CTGAAGAAGGCACCAGCGAATCCGCAACGCCCGAGTCAGGCCCTGGTA<br>CCTCCACAGAACCATCTGAAGGTAGTGCGCCTGGTTCCCCAGCTGGAAG<br>CCCTACTTCCACCGAAGAAGGCACGTCAACCGAACCAAGTGAAGGATC<br>TGCCCCTGGGACCAGCACTGAACCATCTGAGGTTAACCCCAAGAAGAA<br>GCGGAAGGTGGGCATCCACGGCGTGCCCGCCGCCGACAAGAAGTACAG<br>CATCGGCCTGGCCATCGGCACCAACAGCGTGGGCTGGGCCGTGATCAC<br>CGACGAGTACAAGGTGCCCAGCAAGAAGTTCAAGGTGCTGGGCAACAC<br>CGACCGGCACAGCATCAAGAAGAACCTGATCGGCGCCCTGCTGTTCGA<br>CAGCGGCGAGACCGCCGAGGCCACCCGGCTGAAGCGGACCGCCCGGCG<br>GCGGTACACCCGGCGGAAGAACCGGATCTGCTACCTGCAGGAGATCTT<br>CAGCAACGAGATGGCCAAGGTGGACGACAGCTTCTTCCACCGGCTGGA<br>GGAGAGCTTCCTGGTGGAGGAGGACAAGAAGCACGAGCGGCACCCCAT<br>CTTCGGCAACATCGTGGACGAGGTGGCCTACCACGAGAAGTACCCCAC<br>CATCTACCACCTGCGGAAGAAGCTGGTGGACAGCACCGACAAGGCCGA<br>CCTGCGGCTGATCTACCTGGCCCTGGCCCACATGATCAAGTTCCGGGGC | DNMT3A/L-<br>XTEN80-dSpCas9-<br>KRAB (nt) |

-continued

Sequences

| SEQ ID NO | Sequence | Description |
|---|---|---|
| | CACTTCCTGATCGAGGGCGACCTGAACCCCGACAACAGCGACGTGGAC<br>AAGCTGTTCATCCAGCTGGTGCAGACCTACAACCAGCTGTTCGAGGAGA<br>ACCCCATCAACGCCAGCGGCGTGGACGCCAAGGCCATCCTGAGCGCCC<br>GGCTGAGCAAGAGCCGGCGGCTGGAGAACCTGATCGCCCAGCTGCCCG<br>GCGAGAAGAAGAACGGCCTGTTCGGCAACCTGATCGCCCTGAGCCTGG<br>GCCTGACCCCCAACTTCAAGAGCAACTTCGACCTGGCCGAGGACGCCA<br>AGCTGCAGCTGAGCAAGGACACCTACGACGACGACCTGGACAACCTGC<br>TGGCCCAGATCGGCGACCAGTACGCCGACCTGTTCCTGGCCGCCAAGA<br>ACCTGAGCGACGCCATCCTGCTGAGCGACATCCTGCGGGTGAACACCG<br>AGATCACCAAGGCCCCCCTGAGCGCCAGCATGATCAAGCGGTACGACG<br>AGCACCACCAGGACCTGACCCTGCTGAAGGCCCTGGTGCGGCAGCAGC<br>TGCCCGAGAAGTACAAGGAGATCTTCTTCGACCAGAGCAAGAACGGCT<br>ACGCCGGCTACATCGACGGCGGCGCCAGCCAGGAGGAGTTCTACAAGT<br>TCATCAAGCCCATCCTGGAGAAGATGGACGGCACCGAGGAGCTGCTGG<br>TGAAGCTGAACCGGGAGGACCTGCTGCGGAAGCAGCGGACCTTCGACA<br>ACGGCAGCATCCCCCACCAGATCCACCTGGGCGAGCTGCACGCCATCCT<br>GCGCGGCGGCAGGAGGACTTCTACCCCTTCCTGAAGGACAACCGGGAGAA<br>GATCGAGAAGATCCTGACCTTCCGGATCCCCTACTACGTGGGCCCCCTG<br>GCCCGGGGCAACAGCCGGTTCGCTGGATGACCCGGAAGAGCGAGGAG<br>ACCATCACCCCCTGGAACTTCGAGGAGGTGGTGGACAAGGGCGCCAGC<br>GCCCAGAGCTTCATCGAGCGGATGACCAACTTCGACAAGAACCTGCCC<br>AACGAGAAGGTGCTGCCCAAGCACAGCCTGCTGTACGAGTACTTCACC<br>GTGTACAACGAGCTGACCAAGGTGAAGTACGTGACCGAGGGCATGCGG<br>AAGCCCGCCTTCCTGAGCGGCGAGCAGAAGAAGGCCATCGTGGACCTG<br>CTGTTCAAGACCAACCGGAAGGTGACCGTGAAGCAGCTGAAGGAGGAC<br>TACTTCAAGAAGATCGAGTGCTTCGACAGCGTGGAGATCAGCGGCGTG<br>GAGGACCGGTTCAACGCCAGCCTGGGCACCTACCACGACCTGCTGAAG<br>ATCATCAAGGACAAGGACTTCCTGGACAACGAGGAGAACGAGGACATC<br>CTGGAGGACATCGTGCTGACCCTGACCCTGTTCGAGGACCGGGAGATG<br>ATCGAGGAGCGGCTGAAGACCTACGCCCACCTGTTCGACGACAAGGTG<br>ATGAAGCAGCTGAAGCGGCGGCGGTACACCGGCTGGGGCCGGCTGAGC<br>CGGAAGCTGATCAACGGCATCCGGGACAAGCAGAGCGGCAAGACCATC<br>CTGGACTTCCTGAAGAGCGACGGCTTCGCCAACCGGAACTTCATGCAGC<br>TGATCCACGACGACAGCCTGACCTTCAAGGAGGACATCCAGAAGGCCC<br>AGGTGAGCGGCCAGGGCGACAGCCTGCACGAGCACATCGCCAACCTGG<br>CCGGCAGCCCCGCCATCAAGAAGGGCATCCTGCAGACCGTGAAGGTGG<br>TGGACGAGCTGGTGAAGGTGATGGGCCGGCACAAGCCCGAGAACATCG<br>TGATCGAGATGGCCCGGGAGAACCAGACCACCCAGAAGGGCCAGAAG<br>AACAGCCGGGAGCGGATGAAGCGGATCGAGGAGGGCATCAAGGAGCT<br>GGGCAGCCAGATCCTGAAGGAGCACCCCGTGGAGAACACCCAGCTGCA<br>GAACGAGAAGCTGTACCTGTACTACCTGCAGAACGGCCGGGACATGTA<br>CGTGGACCAGGAGCTGGACATCAACCGGCTGAGCGACTACGACGTGGA<br>CGCCATCGTGCCCCAGAGCTTCCTGAAGGACGACAGCATCGACAACAA<br>GGTGCTGACCCGGAGCGACAAGAACCGGGGCAAGAGCGACAACGTGCC<br>CAGCGAGGAGGTGGTGAAGAAGATGAAGAACTACTGGCGGCAGCTGCT<br>GAACGCCAAGCTGATCACCCAGCGGAAGTTCGACAACCTGACCAAGGC<br>CGAGCGGGGCGGCCTGAGCGAGCTGGACAAGGCCGGCTTCATCAAGCG<br>GCAGCTGGTGGAGACCCGGCAGATCACCAAGCACGTGGCCCAGATCCT<br>GGACAGCCGGATGAACACCAAGTACGACGAGAACGACAAGCTGATCCG<br>GGAGGTGAAGGTGATCACCCTGAAGAGCAAGCTGGTGAGCGACTTCCG<br>GAAGGACTTCCAGTTCTACAAGGTGCGGGAGATCAACAACTACCACCA<br>CGCCCACGACGCCTACCTGAACGCCGTGGTGGGCACCGCCCTGATCAA<br>GAAGTACCCCAAGCTGGAGAGCGAGTTCGTGTACGGCGACTACAAGGT<br>GTACGACGTGCGGAAGATGATCGCCAAGAGCGAGCAGGAGATCGGCAA<br>GGCCACCGCCAAGTACTTCTTCTACAGCAACATCATGAACTTCTTCAAG<br>ACCGAGATCACCCTGGCCAACGGCGAGATCCGGAAGCGGCCCCTGATC<br>GAGACCAACGGCGAGACCGGCGAGATCGTGTGGGACAAGGGCCGGGA<br>CTTCGCCACCGTGCGGAAGGTGCTGAGCATGCCCCAGGTGAACATCGTG<br>AAGAAGACCGAGGTGCAGACCGGCGGCTTCAGCAAGGAGAGCATCCTG<br>CCCAAGCGGAACAGCGACAAGCTGATCGCCCGGAAGAAGGACTGGGAC<br>CCCAAGAAGTACGGCGGCTTCGACAGCCCCACCGTGGCCTACAGCGTG<br>CTGGTGGTGGCCAAGGTGGAGAAGGGCAAGAGCAAGAAGCTGAAGAG<br>CGTGAAGGAGCTGCTGGGCATCACCATCATGGAGCGGAGCAGCTTCGA<br>GAAGAACCCCATCGACTTCCTGGAGGCCAAGGGCTACAAGGAGGTGAA<br>GAAGGACCTGATCATCAAGCTGCCCAAGTACAGCCTGTTCGAGCTGGA<br>GAACGGCCGGAAGCGGATGCTGGCCAGCGCCGGCGAGCTGCAGAAGG<br>GCAACGAGCTGGCCCTGCCCAGCAAGTACGTGAACTTCCTGTACCTGGC<br>CAGCCACTACGAGAAGCTGAAGGGCAGCCCCGAGGACAACGAGCAGA<br>AGCAGCTGTTCGTGGAGCAGCACAAGCACTACCTGGACGAGATCATCG<br>AGCAGATCAGCGAGTTCAGCAAGCGGGTGATCCTGGCCGACGCCAACC<br>TGGACAAGGTGCTGAGCGCCTACAACAAGCACCGGGACAAGCCCATCC<br>GGGAGCAGGCCGAGAACATCATCCACCTGTTCACCCTGACCAACCTGG<br>GCGCCCCCGCCGCCTTCAAGTACTTCGACACCACCATCGACCGGAAGCG<br>GTACACCAGCACCAAGGAGGTGCTGGACGCCACCCTGATCCACCAGAG | |

| SEQ ID NO | Sequence | Description |
|---|---|---|
| | CATCACCGGCCTGTACGAGACCCGGATCGACCTGAGCCAGCTGGGCGG<br>CGACAGCGGCGGCAAGCGGCCCGCCGCCACCAAGAAGGCCGGCCAGGC<br>CAAGAAGAAGAAGGCtagCgatgctaagtcactgactgcctggtcccggacactggtgaccttcaagga<br>tgtgtttgtggacttcaccagggaggagtggaagctgctggacactgctcagcagatcctgtacagaa<br>atgtgatgctggagaactataagaacctggtttccttgggttatcagcttactaagccagatgtgat<br>cctccggttggagaagggagaagagccctggctggtggagagagaaattcaccaagagacccatcct<br>gattcagagactgcatttgaaatcaaatcatcagttCCGAAAAAGAAACGCAAAGTTTAG | |
| 647 | MNHDQEFDPPKVYPPVPAEKRKPIRVLSLFDGIATGLLVLKDLGIQVDRYIA<br>SEVCEDSITVGMVRHQGKIMYVGDVRSVTQKHIQEWGPFDLVIGGSPCND<br>LSIVNPARKGLYEGTGRLFFEFYRLLHDARPKEGDDRPFFWLFENVVAMG<br>VSDKRDISRFLESNPVMIDAKEVSAAHRARYFWGNLPGMNRPLASTVNDK<br>LELQECLEHGRIAKFSKVRTITTRSNSIKQGKDQHFPVFMNEKEDILWCTEM<br>ERVFGFPVHYTDVSNMSRLARQRLLGRSWSVPVIRHLFAPLKEYFACVSSG<br>NSNANSRGPSFSSGLVPLSLRGSHMGPMEIYKTVSAWKRQPVRVLSLFRNI<br>DKVLKSLGFLESGSGSGGGTLKYVEDVTNVVRRDVEKWGPFDLVYGSTQP<br>LGSSCDRCPGWYMFQFHRILQYALPRQESQRPFFWIFMDNLLLTEDDQETT<br>TRFLQTEAVTLQDVRGRDYQNAMRVWSNIPGLKSKHAPLTPKEEEYLQAQ<br>VRSRSKLDAPKVDLLVKNCLLPLREYFKYFSQNSLPLGGPSSGAPPPSGGSP<br>AGSPTSTEEGTSESATPESGPGTSTEPSEGSAPGSPAGSPTSTEEGTSTEPSEG<br>SAPGTSTEPSEVNPKKKRKVGIHGVPAADKKYSIGLAIGTNSVGWAVITDE<br>YKVPSKKFKVLGNTDRHSIKKNLIGALLFDSGETAEATRLKRTARRYTRR<br>KNRICYLQEIFSNEMAKVDDSFFHRLEESFLVEEDKKHERHPIFGNIVDEVA<br>YHEKYPTIYHLRKKLVDSTDKADLRLIYLALAHMIKFRGHFLIEGDLNPDN<br>SDVDKLFIQLVQTYNQLFEENPINASGVDAKAILSARLSKSRRLENLIAQLP<br>GEKKNGLFGNLIALSLGLTPNFKSNFDLAEDAKLQLSKDTYDDDLDNLLA<br>QIGDQYADLFLAAKNLSDAILLSDILRVNTEITKAPLSASMIKRYDEHHQDL<br>TLLKALVRQQLPEKYKEIFFDQSKNGYAGYIDGGASQEEFYKFIKPILEKMD<br>GTEELLVKLNREDLLRKQRTFDNGSIPHQIHLGELHAILRRQEDFYPFLKDN<br>REKIEKILTFRIPYYVGPLARGNSRFAWMTRKSEETITPWNFEEVVDKGASA<br>QSFIERMTNFDKNLPNEKVLPKHSLLYEYFTVYNELTKVKYVTEGMRKPA<br>FLSGEQKKAIVDLLFKTNRKVTVKQLKEDYFKKIECFDSVEISGVEDRFNAS<br>LGTYHDLLKIIKDKDFLDNEENEDILEDIVLTLTLFEDREMIEERLKTYAHLF<br>DDKVMKQLKRRRYTGWGRLSRKLINGIRDKQSGKTILDFLKSDGFANRNF<br>MQLIHDDSLTFKEDIQKAQVSGQGDSLHEHIANLAGSPAIKKGILQTVKVV<br>DELVKVMGRHKPENIVIEMARENQTTQKGQKNSRERMKRIEEGIKELGSQI<br>LKEHPVENTQLQNEKLYLYYLQNGRDMYVDQELDINRLSDYDVDAIVPQS<br>FLKDDSIDNKVLTRSDKNRGKSDNVPSEEVVKKMKNYWRQLLNAKLITQR<br>KFDNLTKAERGGLSELDKAGFIKRQLVETRQITKHVAQILDSRMNTKYDEN<br>DKLIREVKVITLKSKLVSDFRKDFQFYKVREINNYHHAHDAYLNAVVGTA<br>LIKKYPKLESEFVYGDYKVYDVRKMIAKSEQEIGKATAKYFFYSNIMNFFK<br>TEITLANGEIRKRPLIETNGETGEIVWDKGRDFATVRKVLSMPQVNIVKKTE<br>VQTGGFSKESILPKRNSDKLIARKKDWDPKKYGGFDSPTVAYSVLVVAKV<br>EKGKSKKLKSVKELLGITIMERSSFEKNPIDFLEAKGYKEVKKDLIIKLPKYS<br>LFELENGRKRMLASAGELQKGNELALPSKYVNFLYLASHYEKLKGSPEDN<br>EQKQLFVEQHKHYLDEIIEQISEFSKRVILADANLDKVLSAYNKHRDKPIRE<br>QAENIIHLFTLTNLGAPAAFKYFDTTIDRKRYTSTKEVLDATLIHQSITGLYE<br>TRIDLSQLGGDSGGKRPAATKKAGQAKKKKASDAKSLTAWSRTLVTFKD<br>VFVDFTREEWKLLDTAQQILYRNVMLENYKNLVSLGYQLTKPDVILRLEK<br>GEEPWLVEREIHQETHPDSETAFEIKSSVPKKKRKV | DNMT3A/L-XTEN80-dSpCas9-KRAB (AA) |
| 648 | AGTAACCATGACCAGGAATTTGACCCCCCAAAGGTTTACCCACCTGTGC<br>CAGCTGAGAAGAGGAAGCCCATCCGCGTGCTGTCTCTCTTTGATGGGAT<br>TGCTACAGGGCTCCTGGTGCTGAAGGACCTGGGCATCCAAGTGGACCG<br>CTACATTGCCTCCGAGGTGTGTGAGGACTCCATCACGGTGGGCATGGTG<br>CGGCACCAGGGAAAGATCATGTACGTCGGGGACGTCCGCAGCGTCACA<br>CAGAAGCATATCCAGGAGTGGGGCCCATTCGACCTGGTGATTGGAGGC<br>AGTCCCTGCAATGACCTCTCCATTGTCAACCCTGCCCGCAAGGGACTTT<br>ATGAGGGTACTGGCCGCCTCTTCTTTGAGTTCTACCGCCTCCTGCATGAT<br>GCGCGGCCCAAGGAGGGAGATGATCGCCCCTTCTTCTGGCTCTTTGAGA<br>ATGTGGTGGCCATGGGCGTTAGTGACAAGAGGGACATCTCGCGATTTCT<br>TGAGTCTAACCCCGTGATGATTGACGCCAAAGAAGTGTCTGCTGCACAC<br>AGGGCCCGTTACTTCTGGGGTAACCTTCCTGGCATGAACAGGCCTTTGG<br>CATCCACTGTGAATGATAAGCTGGAGCTGCAAGAGTGTCTGGAGCACG<br>GCAGAATAGCCAAGTTCAGCAAAGTGAGGACCATTACCACCAGGTCAA<br>ACTCTATAAAGCAGGGCAAAGACCAGCATTTCCCCGTCTTCATGAACGA<br>GAAGGAGGACATCCTGTGGTGCACTGAAATGGAAAGGGTGTTTGGCTT<br>CCCCGTCCACTACACAGACGTCTCCAACATGAGCCGCTTGGCGAGGCAG<br>AGACTGCTGGGCCGATCGTGGAGCGTGCCGGTCATCCGCCACCTCTTCG<br>CTCCGCTGAAGGAATATTTTGCTTGTGTGTCTAGCGGCAATAGTAACGC<br>TAACAGCCGCGGGCCGAGCTTCAGCAGCGGCCTGGTGCCGTTAAGCTTG<br>CGCGGCAGCCATATGGGCCCTATGGAGATATACAAGACAGTGTCTGCA<br>TGGAAGAGACAGCCAGTGCGGGTACTGAGCCTCTTCAGAAACATCGAC<br>AAGGTACTAAAGAGTTTGGGCTTCTTGGAAAGCGGTTCTGGTTCTGGGG | DNMT3A/L(CRISPROFF)-XTEN80-dSpCas9-KRAB (nt) |

| SEQ ID NO | Sequence | Description |
|---|---|---|
| | GAGGAACGCTGAAGTACGTGGAAGATGTCACAAATGTCGTGAGGAGAG<br>ACGTGGAGAAATGGGGCCCCTTTGACCTGGTGTACGGCTCGACGCAGC<br>CCCTAGGCAGCTCTTGTGATCGCTGTCCCGGCTGGTACATGTTCCAGTTC<br>CACCGGATCCTGCAGTATGCGCTGCCTCGCCAGGAGAGTCAGCGGCCCT<br>TCTTCTGGATATTCATGGACAATCTGCTGCTGACTGAGGATGACCAAGA<br>GACAACTACCCGCTTCCTTCAGACAGAGGCTGTGACCCTCCAGGATGTC<br>CGTGGCAGAGACTACCAGAATGCTATGCGGGTGTGGAGCAACATTCCA<br>GGGCTGAAGAGCAAGCATGCGCCCCTGACCCCAAAGGAAGAAGAGTAT<br>CTGCAAGCCCAAGTCAGAAGCAGGAGCAAGCTGGACGCCCCGAAAGTT<br>GACCTCCTGGTGAAGAACTGCCTTCTCCCGCTGAGAGAGTACTTCAAGT<br>ATTTTTCTCAAAACTCACTTCCTCTTGGAGGGCCGAGCTCTGGCGCACC<br>CCCACCAAGTGGAGGGTCTCCTGCCGGGTCCCAACATCTACTGAAGAA<br>GGCACCAGCGAATCCGCAACGCCCGAGTCAGGCCCTGGTACCTCCACA<br>GAACCATCTGAAGGTAGTGCGCCTGGTTCCCCAGCTGGAAGCCCTACTT<br>CCACCGAAGAAGGCACGTCAACCGAACCAAGTGAAGGATCTGCCCCTG<br>GGACCAGCACTGAACCATCTGAGGTTAACCCCAAGAAGAAGCGGAAGG<br>TGGGCATCCACGGCGTGCCCGCCGCCGACAAGAAGTACGACATCGGCC<br>TGGCCATCGGCACCAACAGCGTGGGCTGGGCCGTGATCACCGACGAGT<br>ACAAGGTGCCCAGCAAGAAGTTCAAGGTGCTGGGCAACACCGACCGGC<br>ACAGCATCAAGAAGAACCTGATCGGCGCCCTGCTGTTCGACAGCGGCG<br>AGACCGCCGAGGCCACCCGGCTGAAGCGGACCGCCCGGCGGCGGTACA<br>CCCGGCGGAAGAACCGGATCTGCTACCTGCAGGAGATCTTCAGCAACG<br>AGATGGCCAAGGTGGACGACAGCTTCTTCCACCGGCTGGAGGAGAGCT<br>TCCTGGTGGAGGAGGACAAGAAGCACGAGCGGCACCCCATCTTCGGCA<br>ACATCGTGGACGAGGTGGCCTACCACGAGAAGTACCCCACCATCTACC<br>ACCTGCGGAAGAAGCTGGTGGACAGCACCGACAAGGCCGACCTGCGGC<br>TGATCTACCTGGCCCTGGCCCACATGATCAAGTTCCGGGGCCACTTCCT<br>GATCGAGGGCGACCTGAACCCCGACAACAGCGACGTGGACAAGCTGTT<br>CATCCAGCTGGTGCAGACCTACAACCAGCTGTTCGAGGAGAACCCCATC<br>AACGCCAGCGGCGTGGACGCCAAGGCCATCCTGAGCGCCCGGCTGAGC<br>AAGAGCCGGCGGCTGGAGAACCTGATCGCCCAGCTGCCCGGCGAGAAG<br>AAGAACGGCCTGTTCGGCAACCTGATCGCCCTGAGCCTGGGCCTGACCC<br>CCAACTTCAAGAGCAACTTCGACCTGGCCGAGGACGCCAAGCTGCAGC<br>TGAGCAAGGACACCTACGACGACGACCTGGACAACCTGCTGGCCCAGA<br>TCGGCGACCAGTACGCCGACCTGTTCCTGGCCGCCAAGAACCTGAGCG<br>ACGCCATCCTGCTGAGCGACATCCTGCGGGTGAACACCGAGATCACCA<br>AGGCCCCCCTGAGCGCCAGCATGATCAAGCGGTACGACGAGCACCACC<br>AGGACCTGACCCTGCTGAAGGCCCTGGTGCGGCAGCAGCTGCCCGAGA<br>AGTACAAGGAGATCTTCTTCGACCAGAGCAAGAACGGCTACGCCGGCT<br>ACATCGACGGCGGCGCCAGCCAGGAGGAGTTCTACAAGTTCATCAAGC<br>CCATCCTGGAGAAGATGGACGGCACCGAGGAGCTGCTGGTGAAGCTGA<br>ACCGGGAGGACCTGCTGCGGAAGCAGCGGACCTTCGACAACGGCAGCA<br>TCCCCCACCAGATCCACCTGGGCGAGCTGCACGCCATCCTGCGGCGGCA<br>GGAGGACTTCTACCCCTTCCTGAAGGACAACCGGGAGAAGATCGAGAA<br>GATCCTGACCTTCCGGATCCCCTACTACGTGGGCCCCCTGGCCCGGGGC<br>AACAGCCGGTTCGCCTGGATGACCCGGAAGAGCGAGGAGACCATCACC<br>CCCTGGAACTTCGAGGAGGTGGTGGACAAGGGCGCCAGCGCCCAGAGC<br>TTCATCGAGCGGATGACCAACTTCGACAAGAACCTGCCCAACGAGAAG<br>GTGCTGCCCAAGCACAGCCTGCTGTACGAGTACTTCACCGTGTACAACG<br>AGCTGACCAAGGTGAAGTACGTGACCGAGGGCATGCGGAAGCCCGCCT<br>TCCTGAGCGGCGAGCAGAAGAAGGCCATCGTGGACCTGCTGTTCAAGA<br>CCAACCGGAAGGTGACCGTGAAGCAGCTGAAGGAGGACTACTTCAAGA<br>AGATCGAGTGCTTCGACAGCGTGGAGATCAGCGGCGTGGAGGACCGGT<br>TCAACGCCAGCCTGGGCACCTACCACGACCTGCTGAAGATCATCAAGG<br>ACAAGGACTTCCTGGACAACGAGGAGAACGAGGACATCCTGGAGGACA<br>TCGTGCTGACCCTGACCCTGTTCGAGGACCGGGAGATGATCGAGGAGC<br>GGCTGAAGACCTACGCCCACCTGTTCGACGACAAGGTGATGAAGCAGC<br>TGAAGCGGCGGCGGTACACCGGCTGGGGCCGGCTGAGCCGGAAGCTGA<br>TCAACGGCATCCGGGACAAGCAGAGCGGCAAGACCATCCTGGACTTCC<br>TGAAGAGCGACGGCTTCGCCAACCGGAACTTCATGCAGCTGATCCACG<br>ACGACAGCCTGACCTTCAAGGAGGACATCCAGAAGGCCCAGGTGAGCG<br>GCCAGGGCGACAGCCTGCACGAGCACATCGCCAACCTGGCCGGCAGCC<br>CCGCCATCAAGAAGGGCATCCTGCAGACCGTGAAGGTGGTGGACGAGC<br>TGGTGAAGGTGATGGGCCGGCACAAGCCCGAGAACATCGTGATCGAGA<br>TGGCCCGGGAGAACCAGACCACCCAGAAGGGCCAGAAGAACAGCCGG<br>GAGCGGATGAAGCGGATCGAGGAGGGCATCAAGGAGCTGGGCAGCCA<br>GATCCTGAAGGAGCACCCCGTGGAGAACACCCAGCTGCAGAACGAGAA<br>GCTGTACCTGTACTACCTGCAGAACGGCCGGGACATGTACGTGGACCA<br>GGAGCTGGACATCAACCGGCTGAGCGACTACGACGTGGACGCCATCGT<br>GCCCCAGAGCTTCCTGAAGGACGACAGCATCGACAACAAGGTGCTGAC<br>CCGGAGCGACAAGAACCGGGGCAAGAGCGACAACGTGCCCAGCGAGG<br>AGGTGGTGAAGAAGATGAAGAACTACTGGCGGCAGCTGCTGAACGCCA<br>AGCTGATCACCCAGCGGAAGTTCGACAACCTGACCAAGGCCGAGCGGG<br>GCGGCCTGAGCGAGCTGGACAAGGCCGGCTTCATCAAGCGGCAGCTGG | |

| SEQ ID NO | Sequence | Description |
|---|---|---|
| | TGGAGACCCGGCAGATCACCAAGCACGTGCCCAGATCCTGGACAGCC<br>GGATGAACACCAAGTACGACGAGAACGACAAGCTGATCCGGGAGGTGA<br>AGGTGATCACCCTGAAGAGCAAGCTGGTGAGCGACTTCCGGAAGGACT<br>TCCAGTTCTACAAGGTGCGGGAGATCAACAACTACCACCACGCCCACG<br>ACGCCTACCTGAACGCCGTGGTGGGCACCGCCCTGATCAAGAAGTACC<br>CCAAGCTGGAGAGCGAGTTCGTGTACGGCGACTACAAGGTGTACGACG<br>TGCGGAAGATGATCGCCAAGAGCGAGCAGGAGATCGGCAAGGCCACCG<br>CCAAGTACTTCTTCTACAGCAACATCATGAACTTCTTCAAGACCGAGAT<br>CACCCTGGCCAACGGCGAGATCCGGAAGCGGCCCCTGATCGAGACCAA<br>CGGCGAGACCGGCGAGATCGTGTGGGACAAGGGCCGGGACTTCGCCAC<br>CGTGCGGAAGGTGCTGAGCATGCCCCAGGTGAACATCGTGAAGAAGAC<br>CGAGGTGCAGACCGGCGGCTTCAGCAAGGAGAGCATCCTGCCCAAGCG<br>GAACAGCGACAAGCTGATCGCCCGGAAGAAGGACTGGGACCCCAAGA<br>AGTACGGCGGCTTCGACAGCCCCACCGTGGCCTACAGCGTGCTGGTGGT<br>GGCCAAGGTGGAGAAGGGCAAGAGCAAGAAGCTGAAGAGCGTGAAGG<br>AGCTGCTGGGCATCACCATCATGGAGCGGAGCAGCTTCGAGAAGAACC<br>CCATCGACTTCCTGGAGGCCAAGGGCTACAAGGAGGTGAAGAAGGACC<br>TGATCATCAAGCTGCCCAAGTACAGCCTGTTCGAGCTGGAGAACGGCC<br>GGAAGCGGATGCTGGCCAGCGCCGGCGAGCTGCAGAAGGGCAACGAG<br>CTGGCCCTGCCCAGCAAGTACGTGAACTTCCTGTACCTGGCCAGCCACT<br>ACGAGAAGCTGAAGGGCAGCCCCGAGGACAACGAGCAGAAGCAGCTG<br>TTCGTGGAGCAGCACAAGCACTACCTGGACGAGATCATCGAGCAGATC<br>AGCGAGTTCAGCAAGCGGGTGATCCTGGCCGACGCCAACCTGGACAAG<br>GTGCTGAGCGCCTACAACAAGCACCGGGACAAGCCCATCCGGGAGCAG<br>GCCGAGAACATCATCCACCTGTTCACCCTGACCAACCTGGGCGCCCCCG<br>CCGCCTTCAAGTACTTCGACACCACCATCGACCGGAAGCGGTACACCAG<br>CACCAAGGAGGTGCTGGACGCCACCCTGATCCACCAGAGCATCACCGG<br>CCTGTACGAGACCCGGATCGACCTGAGCCAGCTGGGCGGCGACAGCGG<br>CGGCAAGCGGCCCGCCGCCACCAAGAAGGCCGGCCAGGCCAAGAAGA<br>AGAAGGctagCgatgctaagtcactgactgcctggtcccggacactggtgaccttcaaggatgtgtt<br>tgtgaccttcaccagggaggagtggaagctgctggacactgctcagcagatcctgtacagaaatgtg<br>atgctggagaactataagaacctggtttccttgggttatcagcttactaagccagatgtgatcctcc<br>ggttggagaagggagaagagccctggctggtggagagagaaattcaccaagagacccatcctgattca<br>gagactgcatttgaaatcaaatcatcagttCCGAAAAAGAAACGCAAAGTTTAG | |
| 649 | SNHDQEFDPPKVYPPVPAEKRKPIRVLSLFDGIATGLLVLKDLGIQVDRYIA<br>SEVCEDSITVGMVRHQGKIMYVGDVRSVTQKHIQEWGPPFDLVIGGSPCND<br>LSIVNPARKGLYEGTGRLFFEFYRLLHDARPKEGDDRPFFWLFENVVAMG<br>VSDKRDISRFLESNPVMIDAKEVSAAHRARYFWGNLPGMNRPLASTVNDK<br>LELQECLEHGRIAKFSKVRTITTRSNSIKQGKDQHFPVFMNEKEDILWCTEM<br>ERVFGFPVHYTDVSNMSRLARQRLLGRSWSVPVIRHLFAPLKEYFACVSSG<br>NSNANSRGPSFSSGLVPLSLRGSHMGPMEIYKTVSAWKRQPVRVLSLFRNI<br>DKVLKSLGFLESGSGSGGGTLKYVEDVTNVVRRDVEKWGPFDLVYGSTQP<br>LGSSCDRCPGWYMFQFHRILQYALPRQESQRPFFWIFMDNLLLTEDDQETT<br>TRFLQTEAVTLQDVRGRDYQNAMRVWSNIPGLKSKHAPLTPKEEEYLQAQ<br>VRSRSKLDAPKVDLLVKNCLLPLREYFKYFSQNSLPLGGPSSGAPPPSGGSP<br>AGSPTSTEEGTSESATPESGPGTSTEPSEGSAPGSPAGSPTSTEEGTSTEPSEG<br>SAPGTSTEPSEVNPKKKRKVGIHGVPAADKKYSIGLAIGTNSVGWAVITDE<br>YKVPSKKFKVLGNTDRHSIKKNLIGALLFDSGETAEATRLKRTARRRYTRR<br>KNRICYLQEIFSNEMAKVDDSFFHRLEESFLVEEDKKHERHPIFGNIVDEVA<br>YHEKYPTIYHLRKKLVDSTDKADLRLIYLALAHMIKFRGHFLIEGDLNPDN<br>SDVDKLFIQLVQTYNQLFEENPINASGVDAKAILSARLSKSRRLENLIAQLP<br>GEKKNGLFGNLIALSLGLTPNFKSNFDLAEDAKLQLSKDTYDDDLDNLLA<br>QIGDQYADLFLAAKNLSDAILLSDILRVNTEITKAPLSASMIKRYDEHHQDL<br>TLLKALVRQQLPEKYKEIFFDQSKNGYAGYIDGGASQEEFYKFIKPILEKMD<br>GTEELLVKLNREDLLRKQRTFDNGSIPHQIHLGELHAILRRQEDFYPFLKDN<br>REKIEKILTFRIPYYVGPLARGNSRFAWMTRKSEETITPWNFEEVVDKGASA<br>QSFIERMTNFDKNLPNEKVLPKHSLLYEYFTVYNELTKVKYVTEGMRKPA<br>FLSGEQKKAIVDLLFKTNRKVTVKQLKEDYFKKIECFDSVEISGVEDRENAS<br>LGTYHDLLKIIKDKDFLDNEENEDILEDIVLTLTLFEDREMIEERLKTYAHLF<br>DDKVMKQLKRRRYTGWGRLSRKLINGIRDKQSGKTILDFLKSDGFANRNF<br>MQLIHDDSLTFKEDIQKAQVSGQGDSLHEHIANLAGSPAIKKGILQTVKVV<br>DELVKVMGRHKPENIVIEMARENQTTQKGQKNSRERMKRIEEGIKELGSQI<br>LKEHPVENTQLQNEKLYLYYLQNGRDMYVDQELDINRLSDYDVDAIVPQS<br>FLKDDSIDNKVLTRSDKNRGKSDNVPSEEVVKKMKNYWRQLLNAKLITQR<br>KFDNLTKAERGGLSELDKAGFIKRQLVETRQITKHVAQILDSRMNTKYDEN<br>DKLIREVKVITLKSKLVSDFRKDFQFYKVREINNYHHAHDAYLNAVVGTA<br>LIKKYPKLESEFVYGDYKVYDVRKMIAKSEQEIGKATAKYFFYSNIMNFFK<br>TEITLANGEIRKRPLIETNGETGEIVWDKGRDFATVRKVLSMPQVNIVKKTE<br>VQTGGFSKESILPKRNSDKLIARKKDWDPKKYGGFDSPTVAYSVLVVAKV<br>EKGKSKKLKSVKELLGITIMERSSFEKNPIDFLEAKGYKEVKKDLIIKLPKYS<br>LFELENGRKRMLASAGELQKGNELALPSKYVNFLYLASHYEKLKGSPEDN<br>EQKQLFVEQHKHYLDEIIEQISEFSKRVILADANLDKVLSAYNKHRDKPIRE<br>QAENIIHLFTLTNLGAPAAFKYFDTTIDRKRYTSTKEVLDATLIHQSITGLYE | DNMT3A/L(CRIS<br>PROFF)-XTEN80-<br>dSpCas9-KRAB<br>(AA) |

| SEQ ID NO | Sequence | Description |
|---|---|---|
| | TRIDLSQLGGDSGGKRPAATKKAGQAKKKKASDAKSLTAWSRTLVTFKD VFVDFTREEWKLLDTAQQILYRNVMLENYKNLVSLGYQLTKPDVILRLEK GEEPWLVEREIHQETHPDSETAFEIKSSVPKKKRKV | |
| 650 | aattccacaacctttcaccaaactctgcaagatcccagagtgagaggcctgtatt tccct gctggtggctccagttcaggagcagtaaaccctgttccgactactgcctctccct tatcg tcaatcttctcgaggattggggaccctgcgctgaacatggagaacatcacatcag gattc ctaggaccccttctcgtgttacaggcggggttttcttgttgacaagaatcctca caata ccgcagagtctagactcgtggtggacttctctcaattttctaggggggaactaccg tgtgt cttggccaaaattcgcagtcccaacctccaatcactcaccaacctcctgtcctc caact tgtcctggttatcgctggatgtgtctgcggcgttttatcatcttcctcttcatcc tgctg ctatgcctcatcttcttgttggttcttctggactatcaaggtatgttgcccgttt gtcct ctaattccaggatcctcaaccaccagcacgggaccatgccgaacctgcatgacta ctgct caaggaacctctatgtatcccctcctgttgctgtaccaaaaccttcggacggaaatt gcacc tgtattcccatcccatcatcctgggctttcggaaaattcctatgggagtgggcct cagcc cgtttctcctggctcagtttactagtgccatttgttcagtggttcgtagggcttt ccccc actgtttggctttcagttatatggatgatgtggtattgggggccaagtctgtaca gcatc ttgagtccctttttaccgctgttaccaattttcttttgtctttgggtatacattt aaacc ctaacaaaacaaagagatgggggttactctctgaattttatgggttatgtcattgg aagtt atgggtccttgccacaagaacacatcatacaaaaaatcaaagaatgttttagaaa acttc ctattaacaggccattgattggaaagtatgtcaacgaattgtgggtcttttggg ttttg ctgccccatttacacaatgtggttatcctgcgttaatgcccttgtatgcatgtat tcaat ctaagcaggctttcactttctcgccaacttacaaggcctttctgtgtaaacaata cctga acctttaccccgttgccggcaacggccaggtctgtgccaagtgtttgctgacgc aaccc ccactggctggggcttggtcatgggccatcagcgcgtgcgtggaaccttttcggc tcctc tgccgatccatactgcggaactcctagccgcttgttttgctcgcagcaggtctgg agcaa acattatcgggactgataactctgttgtcctctcccgcaaatatacatcgtatcc atggc tgctaggctgtgctgccaactggatcctgcgcgggacgtcctttgtttacgtccc gtcgg cgctgaatcctgcggacgaccctctcggggtcgcttgggactctctcgtcccct tctcc gtctgccgttccgaccgaccacggggcgcacctctctttacgcggactccccgtc tgtgc cttctcatctgccggaccgtgtgcacttcgcttcacctctgcacgtcgcatggag accac cgtgaacgcccaccgaatgttgcccaaggtcttacataagaggactcttggactc tctgc aatgtcaacgaccgaccttgaggcatacttcaaagactgtttgtttaaagactgg gagga gttgggggaggagattagattaaaggtctttgtactaggaggctgtaggcataaa ttggt ctgcgcaccagcaccatgcaactttttcacctctgcctaatcatctcttgttcat gtcct actgttcaagcctccaagctgtgccttgggtggctttgggcatggacatcgacc cttat aaagaatttggagctactgtggagttactctcgtttttgccttctgacttctttc cttca gtacgagatcttctagataccgcctcagctctgtatcgggaagccttagagtctc ctgag cattgttcacctcaccatactgcactcaggcaagcaattctttgctgggggaac taatg | Hepatitis B Virus genome (Hepatitis B virus subtype ayw, complete genome, GenBank: U95551.1), |

| SEQ ID NO | Sequence | Description |
|---|---|---|
| | actctagctacctgggtgggtgttaatttggaagatccagcatctagagacctag tagtc<br>agttatgtcaacactaatatgggcctaaagttcaggcaactcttgtggtttcaca tttct<br>tgtctcacttttggaagagaaaccgttatagagtatttggtgtctttcggagtgt ggatt<br>cgcactcctccagcttatagaccaccaaatgccctatcctatcaacacttccgg aaact<br>actgttgttagacgacgaggcaggtcccctagaagaagaactccctcgcctcgca gacga<br>aggtctcaatcgccgtcgcagaagatctcaatctcgggaacctcaatgttagt attcc<br>ttggactcataaggtggggaactttactggtctttattcttctactgtacctgtc tttaa<br>tcctcattggaaaacaccatcttttcctaatatacatttacaccaagacattatc aaaaa<br>atgtgaacagtttgtaggcccacttacagttaatgagaaagaagattgcaattg attat<br>gcctgctaggttttatccaaaggttaccaaatatttaccattggataagggtatt aaacc<br>ttattatccagaacatctagttaatcattacttccaaactagacactatttacac actct<br>atggaaggcgggtatattatataagagagaaacaacacatagcgcctcattttgt gggtc<br>accatattcttgggaacaagatctacagcatggggcagaatctttccaccagcaa tcctc<br>tgggattctttcccgaccaccagttggatccagccttcagagcaaacacagcaaa tccag<br>attgggacttcaatcccaacaaggacacctggccagacgccaacaaggtaggagc tggag<br>cattcgggctgggtttcaccccaccgcacggaggcctttttggggtggagccctca ggctc<br>agggcatactacaaactttgccagcaaatccgcctcctgcctccaccaatcgcca gacag<br>gaaggcagcctacccgctgtctccacctttgagaaacactcatcctcaggccat gcagt<br>gg | |
| 651 | NHDQEFDPPKVYPPVPAEKRKPIRVLSLFDGIATGLLVLKDLGIQVDRYIAS EVCEDSITVGMVRHQGKIMYVGDVRSVTQKHIQEWGPFDLVIGGSPCNDL SIVNPARKGLYEGTGRLFFEFYRLLHDARPKEGDDRPFFWLFENVVAMGV SDKRDISRFLESNPVMIDAKEVSAAHRARYFWGNLPGMNRPLASTVNDKL ELQECLEHGRIAKFSKVRTITTRSNSIKQGKDQHFPVFMNEKEDILWCTEME RVFGFPVHYTDVSNMSRLARQRLLGRSWSVPVIRHLFAPLKEYFACVSSGN SNANSRGPSFSSGLVPLSLRGSHMGPMEIYKTVSAWKRQPVRVLSLFRNID KVLKSLGFLESGSGSGGGTLKYVEDVTNVVRRDVEKWGPFDLVYGSTQPL GSSCDRCPGWYMFQFHRILQYALPRQESQRPFFWIFMDNLLLTEDDQETTT RFLQTEAVTLQDVRGRDYQNAMRVWSNIPGLKSKHAPLTPKEEEYLQAQV RSRSKLDAPKVDLLVKNCLLPLREYFKYFSQNSLPL | DNMT3A/L (AA) |
| 652 | TGCCTGTCCTACGAGACAGAGATCCTGACAGTGGAGTATGGCCTGCTGC CAATCGGCAAGATCGTGGAGAAGAGGATCGAGTGTACCGTGTACTCTG TGGATAACAATGGCAACATCTATACACAGCCCGTGGCACAGTGGCACG ATAGGGGAGAGCAGGAGGTGTTCGAGTATTGCCTGGAGGACGGCAGCC TGATCAGGGCAACCAAGGACCACAAGTTCATGACAGTGGATGGCCAGA TGCTGCCCATCGAC | N term Npu Intein (nt) |
| 653 | CLSYETEILTVEYGLLPIGKIVEKRIECTVYSVDNNGNIYTQPVAQWHDRGE QEVFEYCLEDGSLIRATKDHKFMTVDGQMLPID | N term Npu Intein (aa) |
| 654 | ATCAAGATTGCTACACGGAAATACCTGGGAAAGCAGAACGTGTACGAC ATCGGCGTGGAGCGGGATCACAACTTCGCCCTGAAGAATGGCTTTATCG CCAGCAAT | C term Npu Intein (nt) |
| 655 | IKIATRKYLGKQNVYDIGVERDHNFALKNGFIASN | C term Npu Intein (aa) |
| 656 | ATGAAACGGACAGCCGACGGAAGCGAGTTCGAGTCACCAAAGAAGAA GCGGAAAGTCATCAAGATTGCTACACGGAAATACCTGGGAAAGCAGAA CGTGTACGACATCGGCGTGGAGCGGGATCACAACTTCGCCCTGAAGAA TGGCTTTATCGCCAGCAATTGTTTCGACTCTGTTGAAATCAGCGGAGTG GAGGATCGCTTCAACGCATCCCTGGGAACGTATCACGATCTCCTGAAAA TCATTAAAGACAAGGACTTCCTGGACAATGAGGAGAACGAGGACATTC TTGAGGACATTGTCCTCACCCTTACGTTGTTTGAAGATAGGGAGATGAT | dSpCas9-573-C Intein (nt) |

| SEQ ID NO | Sequence | Description |
|---|---|---|
| | TGAAGAACGCTTGAAAACTTACGCTCATCTCTTCGACGACAAAGTCATG<br>AAACAGCTCAAGAGGCGCCGATATACAGGATGGGGCGGCTGTCAAGA<br>AAACTGATCAATGGgatcCGAGACAAGCAGAGTGGAAAGACAATCCTGG<br>ATTTTCTTAAGTCCGATGGATTTGCCAACCGGAACTTCATGCAGTTGAT<br>CCATGATGACTCTCTCACCTTTAAGGAGGACATCCAGAAAGCACAAGTT<br>TCTGGCCAGGGGGACAGTCTTCACGAGCACATCGCTAATCTTGCAGGTA<br>GCCCAGCTATCAAAAAGGGAATACTGCAGACCGTTAAGGTCGTGGATG<br>AACTCGTCAAAGTAATGGGAAGGCATAAGCCCGAGAATATCGTTATCG<br>AGATGGCCCGAGAGAACCAAACTACCCAGAAGGGACAGAAGAACAGT<br>AGGGAAAGGATGAAGAGGATTGAAGAGGGTATAAAAGAACTGGGGTC<br>CCAAATCCTTAAGGAACACCCAGTTGAAAACACCCAGCTTCAGAATGA<br>GAAGCTCTACCTGTACTACCTGCAGAACGGCAGGGACATGTACGTGGA<br>TCAGGAACTGGACATCAATCGGCTCTCCGACTACGACGTGGATGCCATC<br>GTGCCCCAGTCTTTTCTCAAAGATGATTCTATTGATAATAAAGTGTTGA<br>CAAGATCCGATAAAAATAGAGGGAAGAGTGATAACGTCCCCTCAGAAG<br>AAGTTGTCAAGAAATGAAAAATTATTGGCGGCAGCTGCTGAACGCCA<br>AACTGATCACACAACGGAAGTTCGATAATCTGACTAAGGCTGAACGAG<br>GTGGCCTGTCTGAGTTGGATAAAGCCGGCTTCATCAAAAGGCAGCTTGT<br>TGAGACACGCCAGATCACCAAgcacGTGGCCCAAATTCTCGATTCACGCA<br>TGAACACCAAGTACGATGAAAATGACAAACTGATTCGAGAGGTGAAAG<br>TTATTACTCTGAAGTCTAAGCTGGTCTCAGATTTCAGAAAGGACTTTCA<br>GTTTTATAAGGTGAGAGAGATCAACAATTACCACCATGCGCATGATGCC<br>TACCTGAATGCAGTGGTAGGCACTGCACTTATCAAAAAATATCCCAAGC<br>TTGAATCTGAATTTGTTTACGGAGACTATAAAGTGTACGATGTTAGGAA<br>AATGATCGCAAAGTCTGAGCAGGAAATAGGCAAGGCCACCGCTAAGTA<br>CTTCTTTTACAGCAATATTATGAATTTTTTCAAGACCGAGATTACACTGG<br>CCAATGGAGAGATTCGGAAGCGACCACTTATCGAAACAAACGGAGAAA<br>CAGGAGAAATCGTGTGGGACAAGGGTAGGGATTTCGCGACAGTCCGGA<br>AGGTCCTGTCCATGCCGCAGGTGAACATCGTTAAAAAGACCGAAGTAC<br>AGACCGGAGGCTTCTCCAAGGAAAGTATCCTCCCGAAAAGGAACAGCG<br>ACAAGCTGATCGCACGCAAAAAAGATTGGGACCCCAAGAAATACGGCG<br>GATTCGATTCTCCTACAGTCGCTTACAGTGTACTGGTTGTGGCCAAAGT<br>GGAGAAAGGGAAGTCTAAAAAAACTCAAAAGCGTCAAGGAACTGCTGG<br>GCATCACAATCATGGAGCGATCAAGCTTCGAAAAAAACCCCATCGACT<br>TTCTCGAGGCGAAAGGATATAAAGAGGTCAAAAAAGACCTCATCATTA<br>AGCTTCCCAAGTACTCTCTCTTTGAGCTTGAAAACGGCCGGAAACGAAT<br>GCTCGCTAGTGCGGGCGAGCTGCAGAAAGGTAACGAGCTGGCACTGCC<br>CTCTAAATACGTTAATTTCTTGTATCTGGCCAGCCACTATGAAAAGCTC<br>AAAGGGTCTCCCGAAGATAATGAGCAGAAGCAGCTGTTCGTGGAACAA<br>CACAAACACTACCTTGATGAGATCATCGAGCAAATAAGCGAATTCTCCA<br>AAAGAGTGATCCTCGCCGACGCTAACCTCGATAAGGTGCTTTCTGCTTA<br>CAATAAGCACAGGGATAAGCCCATCAGGGAGCAGGCAGAAAACATTAT<br>CCACTTGTTTACTCTGACCAACTTGGGCGCGCCTGCAGCCTTCAAGTAC<br>TTCGACACCACCATAGACAGAAAGCGGTACACCTCTACAAAGGAGGTC<br>CTGGACGCCACACTGATTCATCAGTCAATTACGGGGCTCTATGAAACAA<br>GAATCGACCTCTCTCAGCTCGGTGGAGACAAAAGGCCGGCGGCCACGA<br>AAAAGGCCGGCCAGGCAAAAAAGAAAAAGTGA | |
| 657 | MKRTADGSEFESPKKKRKVIKIATRKYLGKQNVYDIGVERDHNFALKNGFI<br>ASNCFDSVEISGVEDRFNASLGTYHDLLKIIKDKDFLDNEENEDILEDIVLTL<br>TLFEDREMIEERLKTYAHLFDDKVMKQLKRRRYTGWGRLSRKLINGIRDK<br>QSGKTILDFLKSDGFANRNFMQLIHDDSLTFKEDIQKAQVSGQGDSLHEHI<br>ANLAGSPAIKKGILQTVKVVDELVKVMGRHKPENIVIEMARENQTTQKGQ<br>KNSRERMKRIEEGIKELGSQILKEHPVENTQLQNEKLYLYYLQNGRDMYV<br>DQELDINRLSDYDVDAIVPQSFLKDDSIDNKVLTRSDKNRGKSDNVPSEEV<br>VKKMKNYWRQLLNAKLITQRKFDNLTKAERGGLSELDKAGFIKRQLVETR<br>QITKHVAQILDSRMNTKYDENDKLIREVKVITLKSKLVSDFRKDFQFYKVR<br>EINNYHHAHDAYLNAVVGTALIKKYPKLESEFVYGDYKVYDVRKMIAKSE<br>QEIGKATAKYFFYSNIMNFFKTEITLANGEIRKRPLIETNGETGEIVWDKGR<br>DFATVRKVLSMPQVNIVKKTEVQTGGFSKESILPKRNSDKLIARKKDWDPK<br>KYGGFDSPTVAYSVLVVAKVEKGKSKKLKSVKELLGITIMERSSFEKNPIDF<br>LEAKGYKEVKKDLIIKLPKYSLFELENGRKRMLASAGELQKGNELALPSKY<br>VNFLYLASHYEKLKGSPEDNEQKQLFVEQHKHYLDEIIEQISEFSKRVILAD<br>ANLDKVLSAYNKHRDKPIREQAENIIHLFTLTNLGAPAAFKYFDTTIDRKRY<br>TSTKEVLDATLIHQSITGLYETRIDLSQLGGDKRPAATKKAGQAKKKK | dSpCas9-573-C Intein (aa) |
| 658 | SGSETPGTSESATPES | Linker (aa) |
| 659 | ATGGCGGCCATCCCAGCCCTGGACCCAGAGGCCGAGCCCAGCATGGAC<br>GTGATTTTGGTGGGATCCAGTGAGCTCTCAAGCTCCGTTTCACCCGGGA<br>CAGGCAGAGATCTTATTGCATATGAAGTCAAGGCTAACCAGCGAAATA<br>TAGAAGACATCTGCATCTGCTGCGGAAGTCTCCAGGTTCACACACAGCA<br>CCCTCTGTTTGAGGGAGGGATCTGCGCCCCATGTAAGGACAAGTTCCTG<br>GATGCCCTCTTCCTGTACGACGATGACGGGTACCAATCCTACTGCTCCA | DNMT3L (nt) |

| SEQ ID NO | Sequence | Description |
|---|---|---|
|  | TCTGCTGCTCCGGAGAAACGCTGCTCATCTGCGGAAACCCTGATTGCAC<br>CCGATGCTACTGCTTCGAGTGTGTGGATAGCCTGGTCGGCCCCGGGACC<br>TCGGGGAAGGTGCACGCCATGAGCAACTGGGTGTGCTACCTGTGCCTGC<br>CGTCCTCCCGAAGCGGGCTGCTGCAGCGTCGGAGGAAGTGGCGCAGCC<br>AGCTCAAGGCCTTCTACGACCGAGAGTCGGAGAATCCCCTTGAGATGTT<br>CGAAACCGTGCCTGTGTGGAGGAGACAGCCAGTCCGGGTGCTGTCCCTT<br>TTTGAAGACATCAAGAAAGAGCTGACGAGTTTGGGCTTTTTGGAAAGTG<br>GTTCTGACCCGGGACAACTGAAGCATGTGGTTGATGTCACAGACACAGT<br>GAGGAAGGATGTGGAGGAGTGGGGACCCTTCGATCTTGTGTACGGCGC<br>CACACCTCCCCTGGGCCACACCTGTGACCGTCCTCCCAGCTGGTACCTG<br>TTCCAGTTCCACCGGCTCCTGCAGTACGCACGGCCCAAGCCAGGCAGCC<br>CCAGGCCCTTCTTCTGGATGTTCGTGGACAATCTGGTGCTGAACAAGGA<br>AGACCTGGACGTCGCATCTCGCTTCCTGGAGATGGAGCCAGTCACCATC<br>CCAGATGTCCACGGCGGATCCTTGCAGAATGCTGTCCGCGTGTGGAGCA<br>ACATCCCAGCCATAAGGAGCAGGCACTGGGCTCTGGTTTCGGAAGAAG<br>AATTGTCCCTGCTGGCCCAGAACAAGCAGAGCTCGAAGCTCGCGGCCA<br>AGTGGCCCACCAAGCTGGTGAAGAACTGCTTTCTCCCCCTAAGAGAATA<br>TTTCAAGTATTTTTCAACAGAACTCACTTCCTCTTTA |  |
| 660 | ACCTACGGGCTGCTGCGGCGGCGAGAGGACTGGCCCTCCCGGCTCCAG<br>ATGTTCTTCGCTAATAACCACGACCAGGAATTTGACCCTCCAAAGGTTT<br>ACCCACCTGTCCCAGCTGAGAAGAGGAAGCCCATCCGGGTGCTGTCTCT<br>CTTTGATGGAATCGCTACAGGGCTCCTGGTGCTGAAGGACTTGGGCATT<br>CAGGTGGACCGCTACATTGCCTCGGAGGTGTGTGAGGACTCCATCACGG<br>TGGGCATGGTGCGGCACCAGGGGAAGATCATGTACGTCGGGGACGTCC<br>GCAGCGTCACACAGAAGCATATCCAGGAGTGGGGCCCATTCGATCTGG<br>TGATTGGGGGCAGTCCCTGCAATGACCTCTCCATCGTCAACCCTGCTCG<br>CAAGGGCCTCTACGAGGGCACTGGCCGGCTCTTCTTTGAGTTCTACCGC<br>CTCCTGCATGATGCGCGGCCCAAGGAGGGAGATGATCGCCCCTTCTTCT<br>GGCTCTTTGAGAATGTGGTGGCCATGGGCGTTAGTGACAAGAGGGACA<br>TCTCGCGATTTCTCGAGTCCAACCCTGTGATGATTGATGCCAAAGAAGT<br>GTCAGCTGCACACAGGGCCCGCTACTTCTGGGGTAACCTTCCCGGTATG<br>AACAGGCCGTTGGCATCCACTGTGAATGATAAGCTGGAGCTGCAGGAG<br>TGTCTGGAGCATGGCAGGATAGCCAAGTTCAGCAAAGTGAGGACCATT<br>ACTACGAGGTCAAACTCCATAAAGCAGGGCAAAGACCAGCATTTTCCT<br>GTCTTCATGAATGAGAAAGAGGACATCTTATGGTGCACTGAAATGGAA<br>AGGGTATTTGGTTTCCCAGTCCACTATACTGACGTATCCAACATGAGCC<br>GCTTGGCGAGGCAGAGACTGCTGGGCCGGTCATGGAGCGTGCCAGTCA<br>TCCGCCACCTCTTCGCTCCGCTGAAGGAGTATTTTGCGTGTGTG | DNMT3A (nt) |
| 661 | TYGLLRRREDWPSRLQMFFANNHDQEFDPPKVYPPVPAEKRKPIRVLSLFD<br>GIATGLLVLKDLGIQVDRYIASEVCEDSITVGMVRHQGKIMYVGDVRSVTQ<br>KHIQEWGPFDLVIGGSPCNDLSIVNPARKGLYEGTGRLFFEFYRLLHDARPK<br>EGDDRPFFWLFENVVAMGVSDKRDISRFLESNPVMIDAKEVSAAHRARYF<br>WGNLPGMNRPLASTVNDKLELQECLEHGRIAKFSKVRTITTRSNSIKQGKD<br>QHFPVFMNEKEDILWCTEMERVFGFPVHYTDVSNMSRLARQRLLGRSWSV<br>PVIRHLFAPLKEYFACV | DNMT3A (AA) |
| 662 | AACCATGACCAGGAATTTGACCCCCCAAAGGTTTACCCACCTGTGCCAG<br>CTGAGAAGAGGAAGCCCATCCGCGTGCTGTCTCTCTTTGATGGGATTGC<br>TACAGGGCTCCTGGTGCTGAAGGACCTGGGCATCCAAGTGGACCGCTA<br>CATTGCCTCCGAGGTGTGTGAGGACTCCATCACGGTGGGCATGGTGCGG<br>CACCAGGGGAAGATCATGTACGTCGGGGACGTCCGCAGCGTCACACAG<br>AAGCATATCCAGGAGTGGGGCCCATTCGACCTGGTGATTGGAGGCAGT<br>CCCTGCAATGACCTCTCCATTGTCAACCCTGCCCGCAAGGGACTTTATG<br>AGGGTACTGGCCGCCTCTTCTTTGAGTTCTACCGCCTCCTGCATGATGCG<br>CGGCCCAAGGAGGAGATGATCGCCCCTTCTTCTGGCTCTTTGAGAATG<br>TGGTGGCCATGGGCGTTAGTGACAAGAGGGACATCTCGCGATTTCTTGA<br>GTCTAACCCCGTGATGATTGACGCCAAAGAAGTGTCTGCTGCACACAGG<br>GCCCGTTACTTCTGGGGTAACCTTCCTGGCATGAACAGGCCTTTGGCAT<br>CCACTGTGAATGATAAGCTGGAGCTGCAAGAGTGTCTGGAGCACGGCA<br>GAATAGCCAAGTTCAGCAAAGTGAGGACCATTACCACCAGGTCAAACT<br>CTATAAAGCAGGGCAAAGACCAGCATTTCCCCGTCTTCATGAACAGA<br>AGGAGGACATCCTGTGGTGCACTGAAATGGAAAGGGTGTTTGGCTTCCC<br>CGTCCACTACACAGACGTCTCCAACATGAGCCGCTTGGCGAGGCAGAG<br>ACTGCTGGGCCGATCGTGGAGCGTGCCGGTCATCCGCCACCTCTTCGCT<br>CCGCTGAAGGAATATTTTGCTTGTGTGTCTAGCGGCAATAGTAACGCTA<br>ACAGCCGCGGGCCGAGCTTCAGCAGCGGCCTGGTGCCGTTAAGCTTGC<br>GCGGCAGCCATATGGGCCCTATGGAGATATACAAGACAGTGTCTGCAT<br>GGAAGAGACAGCCAGTGCGGGTACTGAGCCTCTTCAGAAACATCGACA<br>AGGTACTAAAGAGTTTGGGCTTCTTGGAAAGCGGTTCTGGTTCTGGGGG<br>AGGAACGCTGAAGTACGTGGAAGATGTCACAAATGTCGTGAGGAGAGA<br>CGTGGAGAAATGGGCCCCTTTGACCTGGTGTACGGCTCGACGCAGCCC<br>CTAGGCAGCTCTTGTGATCGCTGTCCCGGCTGGTACATGTTCCAGTTCC | DNMT3A/L v1<br>(nt) |

| SEQ ID NO | Sequence | Description |
|---|---|---|
|  | ACCGGATCCTGCAGTATGCGCTGCCTCGCCAGGAGAGTCAGCGGCCCTT<br>CTTCTGGATATTCATGGACAATCTGCTGCTGACTGAGGATGACCAAGAG<br>ACAACTACCCGCTTCCTTCAGACAGAGGCTGTGACCCTCCAGGATGTCC<br>GTGGCAGAGACTACCAGAATGCTATGCGGGTGTGGAGCAACATTCCAG<br>GGCTGAAGAGCAAGCATGCGCCCCTGACCCCAAAGGAAGAAGAGTATC<br>TGCAAGCCCAAGTCAGAAGCAGGAGCAAGCTGGACGCCCCGAAAGTTG<br>ACCTCCTGGTGAAGAACTGCCTTCTCCCGCTGAGAGAGTACTTCAAGTA<br>TTTTTCTCAAAACTCACTTCCTCTT |  |
| 663 | AACCACGATCAGGAGTTTGACCCCCCTAAGGTGTACCCACCCGTGCCAG<br>CCGAGAAGAGGAAGCCCATCCGCGTGCTGTCCCTGTTCGACGGCATCGC<br>CACAGGCCTGCTGGTGCTGAAGGATCTGGGCATCCAGGTGGACAGATA<br>TATCGCCTCCGAGGTGTGCGAGGATTCTATCACCGTGGGCATGGTGAGG<br>CACCAGGGCAAGATCATGTACGTGGGCGACGTGCGCAGCGTGACACAG<br>AAGCACATCCAGGAGTGGGGACCCTTCGACCTGGTCATCGGAGGCAGC<br>CCCTGTAATGACCTGTCCATCGTGAACCCTGCAAGGAAGGGCCTGTATG<br>AGGGAACCGGCAGACTGTTCTTTGAGTTCTACAGGCTGCTGCACGACGC<br>CCGCCCTAAGGAGGGCGATGACAGGCCATTCTTTTGGCTGTTTGAGAAC<br>GTGGTGGCCATGGGCGTGAGCGACAAGCGGGATATCTCCAGATTCCTG<br>GAGTCTAATCCCGTGATGATCGATGCAAAGGAGGTGTCTGCCGCACAC<br>AGGGCAAGGTACTTTTGGGGAAATCTGCCTGGCATGAACCGCCCACTG<br>GCCAGCACCGTGAACGACAAGCTGGAGCTGCAGGAGTGCCTGGAGCAC<br>GGAAGGATCGCCAAGTTCTCCAAGGTGCGGACAATCACCACAAGATCT<br>AACAGCATCAAGCAGGGCAAGGATCAGCACTTCCCCGTGTTCATGAAT<br>GAGAAGGAGGACATCCTGTGGTGTACCGAGATGGAGCGCGTGTTCGGC<br>TTTCCAGTGCACTATACAGACGTGAGCAATATGAGCCGGCTGGCAAGG<br>CAGAGACTGCTGGGCCGGTCCTGGTCTGTGCCAGTGATCAGACACCTGT<br>TCGCCCCCCTGAAGGAGTACTTTGCCTGCGTGTCTAGCGGCAACTCTAA<br>TGCCAACAGCAGAGGCCCTTCCTTTTCCTCTGGCCTGGTGCCACTGTCTC<br>TGAGGGGCAGCCACATGGGCCCCATGGAGATCTACAAGACCGTGTCCG<br>CCTGGAAGAGGCAGCCTGTGCGCGTGCTGTCTCTGTTCCGCAACATCGA<br>CAAGGTGCTGAAGAGCCTGGGCTTTCTGGAGAGCGGATCCGGATCTGG<br>AGGAGGCACCCTGAAGTATGTGGAGGATGTGACAAATGTGGTGCGGAG<br>AGATGTGGAGAAGTGGGGCCCCTTCGATCTGGTGTACGGATCCACCCA<br>GCCACTGGGAAGCTCCTGCGATAGGTGTCCAGGATGGTATATGTTCCAG<br>TTTCACAGAATCCTGCAGTACGCACTGCCAAGGCAGGAGAGCCAGCGC<br>CCTTTCTTTTGGATCTTTATGGACAACCTGCTGCTGACAGAGGATGACC<br>AGGAGACAACAACCCGCTTCCTGCAGACAGAGGCAGTGACCCTGCAGG<br>ATGTGAGGGGACGCGACTATCAGAATGCCATGCGGGTGTGGTCTAACA<br>TCCCTGGCCTGAAGAGCAAGCACGCCCCCCTGACCCCTAAGGAGGAGG<br>AGTACCTGCAGGCCCAGGTGCGGAGCAGATCCAAGCTGGATGCCCCTA<br>AGGTGGACCTGCTGGTGAAGAATTGTCTGCTGCCACTGCGGGAGTACTT<br>CAAGTACTTTAGTCAGAATAGCCTGCCACTG | DNMT3A/L v2<br>(nt) |
| 664 | MGPMEIYKTVSAWKRQPVRVLSLFRNIDKVLKSLGFLESGSGSGGGTLKY<br>VEDVTNVVRRDVEKWGPFDLVYGSTQPLGSSCDRCPGWYMFQFHRILQY<br>ALPRQESQRPFFWIFMDNLLLTEDDQETTTRFLQTEAVTLQDVRGRDYQN<br>AMRVWSNIPGLKSKHAPLTPKEEEYLQAQVRSRSKLDAPKVDLLVKNCLL<br>PLREYFKYFSQNSLPL | Murine DNMT3L |
| 665 | NHDQEFDPPKVYPPVPAEKRKPIRVLSLFDGIATGLLVLKDLGIQVDRYIAS<br>EVCEDSITVGMVRHQGKIMYVGDVRSVTQKHIQEWGPFDLVIGGSPCNDL<br>SIVNPARKGLYEGTGRLFFEFYRLLHDARPKEGDDRPFFWLFENVAMGV<br>SDKRDISRFLESNPVMIDAKEVSAAHRARYFWGNLPGMNRPLASTVNDKL<br>ELQECLEHGRIAKFSKVRTITTRSNSIKQGKDQHFPVFMNEKEDILWCTEME<br>RVFGFPVHYTDVSNMSRLARQRLLGRSWSVPVIRHLFAPLKEYFACV | Human DNMT3A |
| 666 | NPLEMFETVPVWRRQPVRVLSLFEDIKKELTSLGFLESGSDPGQLKHVVDV<br>TDTVRKDVEEWGPFDLVYGATPPLGHTCDRPPSWYLFQFHRLLQYARPKP<br>GSPRPFFWMFVDNLVLNKEDLDVASRFLEMEPVTIPDVHGGSLQNAVRVW<br>SNIPAIRSRHWALVSEEELSLLAQNKQSSKLAAKWPTKLVKNCFLPLREYF<br>KYFSTELTSSL | C-terminal human<br>DNM3L |
| 667 | SSGNSNANSRGPSFSSGLVPLSLRGSH | Linker |
| 668 | MGSRETPSSCSKTLETLDLETSDSSSPDADSPLEEQWLKSSPALKEDSVDVV<br>LEDCKEPLSPSSPPTGREMIRYEVKVNRRSIEDICLCCGTLQVYTRHPLFEGG<br>LCAPCKDKFLESLFLYDDDGHQSYCTICCSGGTLFICESPDCTRCYCFECVD<br>ILVGPGTSERINAMACWVCFLCLPFSRSGLLQRRKRWRHQLKAFHDQEGA<br>GPMEIYKTVSAWKRQPVRVLSLFRNIDKVLKSL<br>GFLESGSGSGGGTLKYVEDVTNVVRRDVEKWGPFDLVYGSTQPLGSSCDR<br>CPGWYMFQFHRILQYALPRQESQRPFFWIFMDNLLLTEDDQETTTRFLQTE<br>AVTLQDVRGRDYQNAMRVWSNIPGLKSKHAPLTPKEEEYLQAQVRSRSKL<br>DAPKVDLLVKNCLLPLREYFKYFSQNSLPL | Murine DNMT3L |

-continued

| SEQ ID NO | Sequence | Description |
|---|---|---|
| 669 | RTLVTFKDVFVDFTREEWKLLDTAQQILYRNVMLENYKNLVSLGYQLTKP DVILRLEKGEEPWLVEREIHQETHPDSETAFEIKSSV | KRAB |
| 670 | PKKKRKVGIHGVPAA | NLS and linker |
| 671 | DYKDDDDK | Flag tag |
| 672 | EASGSGRASPGIPGSTR | Linker |
| 673 | GIHGVPAA | Linker |
| 674 | MDYKDHDGDYKDHDI DYKDDDDK | 3 x Flag peptide |
| 675 | YPYDVPDYA | HA tag |
| 676 | HHHHHH | poly-histidine tag |
| 677 | KRPAATKKAGQAKKKKASDAKSLTAWS | Linker |
| 678 | NTCCACAGCCTTCCACCAAGCTCTGCAGGATCCCAGAGTCAGGGGTCTG TATTTTCCTGCTGGTGGCTCCAGTTCAGGAACAGTAAACCCTGCTCCGA ATATTGCCTCTCACATCTCGTCAATCTCCGCGAGGACTGGGGACCCTGT GACGAACATGGAGAACATCACATCAGGATTCCTAGGACCCCTGCTCGT GTTACAGGCGGGGTTTTTCTCGTTGACAAGAATCCTCACAATACCGCAG AGTCTAGACTCGTGGTGGACTTCTCTCAGTTTTCTAGGGGGTCCACCCG TGTGTCTTGGCCAAAATTCGCAGTCCCCAACCTCCAATCACTCACCAAC CTCCTGTCCTCCAATCTGTCCTGGTTATCGCTGGATGTGTCTGCGGCGTT TTATCATATTCCTCTTCATCCTGCTGCTATGCCTCATCTTCTTATTGGTTC TTCTGGATTATCAAGGTATGTTGCCCGTTTGTCCTCTAATTCCAGGATCA ACAACAACCAGTACGGGACCATGCAAAACCTGCACGACTCCTGCTCAA GGCAACTCTATGTTTCCCTCATGTTGCTGTACAAAACCTACGGATGGAA ATTGCACCTGTATTCCCATCCCATCGTCTTGGGCTTTCGCAAAATACCTA TGGGAGTGGGCCTCAGTCCGTTTCTCTTGGCTCAGTTTACTAGTGCCATT TGTTCAGTGGTTCGTAGGGCTTTCCCCCACTGTTTGGCTTTCAGCTATAT GGATGATGTGGTATTGGGGGCCAAGACTGTACAGCATCGTGAGTCCCTT TATACCGCTGTTACCAATTTTCTTTTGTCTCTGGGTATACATTTAAACCC TAACAAAACAAAAGATGGGGTTATTCCCTAAACTTCATGGGTTACGTA ATTGGAAGTTGGGGGACATTGCCACAAGATCATATTGTACAAAAGATC AAACACTGTTTTAGAAAACTTCCTGTAAACAGGCCTATTGATTGGAAAG TATGTCAAAGGATTGTGGGTCTTTTGGGCTTTGCTGCTCCATTTACACAA TGTGGATATCCTGCCTTAATGCCTTTGTATGCATGTATACAAGCTAAAC AGGCTTTCACTTTCTCGCCAACTTACAAGGCCTTTCTAAGTAAACAGTA CCTGAACCTTTACCCCGTTGCTCGGCAACGGCCAGGTCTGTGCCAAGTG TTTGCTGACGCAACCCCCACTGGCTGGGGCTTAGCCATAGGCCATCAGC GCATGCGTGGAACCTTTGTGGCTCCTCTGCCGATCCATACTGCGGAACT CCTAGCCGCTTGTTTTGCTCGCAGCCGGTCTGGAGCAAAGCTCATCGGA ACTGACAATTCTGTCGTCCTCTCGCGGAAATATACATCGTTTCCATGGCT GCTAGGCTGTACTGCCAACTGGATCCTTCGCGGGACGTCCTTTGTTTAC GTCCCGTCGGCGCTGAATCCCGCGGACGACCCCTCTCGGGGCCGCTTGG GACTCTCTCGTCCCCTTCTCCGTCTGCCGTTCCAGCCGACCACGGGGCG CACCTCTCTTTACGCGGTCTCCCCGTCTGTGCCTTCTCATCTGCCGGTCC GTGTGCACTTCGCTTCACCTCTGCACGTTGCATGGAGACCACCGTGAAC GCCCATCAGAGCCTGCCCAAGGTCTTACATAAGAGGACTCTTGGACTCC CAGCAATGTCAACGACCGACCTTGAGGCCTACTTCAAAGACTGTGTGTT TAAGGACTGGGAGGAGCTGGGGGAGGAGATTAGGTTAATGATCTTTGT ATTAGGAGGCTGTAGGCATGAGCCTTTTATGCCTAAGAATGTGTCTGTC TCATAATGCAAGTGGTCAATCCAGCCAGCACCATGCGAACTTTTTCACC TCTGCCTAATCATCTTGTACATGTCCCACTGTTCAAGCCTCCAAGCTG TGCCTTGGGTGGCTTTGGGGCATGGACATTGACCCTTATAAAGAATTTG GAGCTACTGTGGAGTTACTCTCGTTTTTGCCTTCTGACTTTTTTCCTTCCG TCAGAGATCTCCTAGACACCGCCTCAGCTCTGTATCGGGAAGCCTTAGA GTCTCCTGAGCATTGCTCTCCTCACCATACTNNNNNNNNNNNNNNNNNNN NNNNNNNNNNNNNNNNNNNNNNNNNNNNNNNNNNNNNNNNNNNN NNNNNNNNNNNNNNNNNNNNNNNNNNNNNNNNNNNNNNNNNNNN NNNNNNNNNNNNNNNNNNNNNNNNNNNNNNNNNNNNNNNNNNNN NNNNNNNNNNNNNNNNNNNNNNNNNNNNNNNNNNNNNNNNNNNN NNNNNNNNNNNNNNNNNNNNNNNNNNNNNNNNNNNNNNNNNNNN NNNNNNNNNNNNNNNNNNNNNNNNNNNNNNNNNNNNNNNNNNNN NNNNNNNNNNNNNNNNNNNNNNNNNNNNNNNNNNNNNNNNNNNN NNNNNNNNNNNNNNNNNNNNNNNNNNNNNNNNNNNNNNNNNNNN NNNNNNNNNNNNNNNNNNNNNNNNNNNNNNNNNNNNNNNNNNNN NNNNNNNNNNNNNNNNNNNNNNNNNNNNNNNNNNNNNNNNNNNN | Hep3B Consensus sequence (3222 bp) |

| SEQ ID NO | Sequence | Description |
|---|---|---|
| | NNNNNNNNNNNNNNNNNNNNNNNNNNNNNNNNNNNNNNNN<br>NNNNNNNNNNNNNNNNNNNNNNNNNNNNNNNNNNNNNNNN<br>NNNNNNNNNNNNNNNNNNNNNNNNNNNNNNNNNNNNNNNN<br>NNNNNNNNNNNNNNNNNNNNNNNNNNNNNNNNNNNNNNNN<br>NNNNNNNNNNNNNNNNNNNNNNNNNNNNNNNNNNNNNNNN<br>NNNNNNNNNNNNNNNNNNNNNNNNNNNNNNNNNNNNNNNN<br>NNNNNNNNNNNNNNNNNNNNNNNNNNNNNNNNNNNNNNNN<br>NNNNNNNNNNNNNNNNNNNNNNNNNNNNNNNNNNNNNNNN<br>NNNNNNNNNNNNNNNNNNNCCTCTGGGATTCTTTCCCGATCATCAGTTGGA<br>CCNNNNNNNNNNNNNNNNNNNNNNNNNAATCCAGATTGGGACTTCAACC<br>CCATCAAGGACCACTGGCCAGCAGCCAACCAGGTAGGAGTGGGAGCAT<br>TCGGGCCAGGGTTCACCCCTCCACACGGCGGTGTTTTGGGGTGGAGCCC<br>TCAGGCTCAGGGCATACTACAAACTGTGTCAACAATTCCTCCTCCTGCC<br>TCCACCAATCGGCAGTCAGGAAGGCAGCCTACTCCCATCTCTCCACCTC<br>TAAAAGACAGTCATCCTCAGGCCACGCAGTGGAA | |
| 679 | ttccacagccttccaccaagctctgcaagatcccagagtcaggggcctgtattttcctgctggtggctcc<br>agttcaggaacagtaaaccctgctcagaatattgcctctcacatctcgtcaatctcctcgaggactgggg<br>accctgcaccgaacatggagaacattacatcaggattcctaggaccccctgctcgtgttacaggcgggtt<br>tttcttgttgacaagaatcctcacaataccacagagtctagactcgtggtggacttctctcaattttcta<br>ggggatcaccgtgtgtcttggccaaaattcgcagtcccaaactccaatcactcaccaacctcctgtc<br>ctccaatttgtcctggttatcgctggatgtgtctgcggcgttttatcatattcctcttcatcctgctgct<br>atgcctcatcttcttattggttcttctggactatcaaggtatgttgcccgtttgtcctctaattccagga<br>tccacaacaaccagtacgggaccctgcaaaacctgcacgactcctgctcaaggcaactctatgtttcct<br>catgttgctgtacaaaacctacggatggaaattgcacctgtattcccatcccatcatcttgggctttcgc<br>aaaatacctatgggagtggggctcagtccgtttctcttggctcagtttactagtgccatttgttcagtg<br>gttcgtagggctttcccccactgttttggctttcagttatatgatgatgtggtattggggggccaaatctg<br>tacaacatcttgagtccctttataccgctgttaccaattttcttttgtctttgggtatacatttaaaccc<br>taacaaaacgaagagatggggttattccctaaacttcatgggatatgtaattggaagttggggtaccttg<br>ccacaggatcatattgtacaaaaaatcaaacgctgttttaggaaacttcctgtcaatcgacctattgatt<br>ggaaagtatgtcaaagaattgtgggtcttttgggctttgccgcgcccttacaaatgtggttacccctg<br>ccttaatgcctttatatgcatgtatacaagcaaaacaggcttttacttttctcgccaacttacaaggcctt<br>tctaagtaaacagtatatgaaccctttacccccgttgcccggcaacggcctggcctgtgccaagtgtttgct<br>gacgcaaccccactggctggggcttggctatgggccatcggtcaagccatgcgtggaacctttgtggctcctc<br>tgccgatccatactgcggaacttcttgcagcttgttttgctcgcagccggtctggagcgaaactcatcgg<br>gactgataattctgtcgtcctttctcggaaatatacatcatttccatggctgctaggttgtgctgctaac<br>tggattcttcgcgggacgtccttttgtctacgtcccgtcggcgctgaatcctgcggacgacccctcccggg<br>gccgcttgggactctatcgtccccttcttcgtctgccgtaccgtccgaccacggggcgcacctctctta<br>cgcggtctccccgtctgtgccttctcatctgccggtccgtgtgcacttcgcttcacctctgcacgttgca<br>tggagaccaccgtgaacgcccatcggatcctgcccaaggtcttacataagaggactcttggactccagc<br>aatgtcaacgaccgaccttgaggcttacttcaaagactgtgtgtttaaagactgggaggagttgggggag<br>gagattaggttaaatattaggagggctgtaggcataaattggtctgcgcaccatcatcatgcaacttttc<br>acctctgcctattcatctctcgttcatgtcctactgttcaagcctccaagctgtgccttgggtggcttta<br>gggcatggacattgacccttataaagaatttggagctactgtggagttactctcgtttttgccttctgac<br>ttctttccttcggtccgagatctcctagacaccgcctcagctctatatcgggaagcttagagtctcctg<br>agcattgttcccctcatcatacagcactcaggcaagcaattctttgctgggggaattaatgactctagc<br>tacctgggggtaataatttggaagatccagcatccagggatctagtagtcaattatgtgaatactaaca<br>tgggcctaaagatcagacaactattgtggtttcatatttcttgccttacttttggaagagaaacagtgct<br>tgagtatttggtctccttcggagtgtggattcgcactcctccagcctatagaccaccaaatgcccctatc<br>ttatcaacacttccggaaactactgttgttagacgacgaggacaggtccccctagaagaagaact<br>ccctcgcctcgcagacgaagatctcaatcgccgcgtcgcagaagatctcaatcctcgggaatctcaatgtt<br>agtattccttggactcataaggtggggaaattttactgggctttattcctctactgtccctatctttaatc<br>ctgaatggcaaacgccttcctttcctaaaatccatttacacgaggacattattaataggtgtcagcaatt<br>tgtaggccctctcactgtaaatgaaaagagaagattgaacttaattatgcctgctaggttttatcctaac<br>tccactaaatatttgcctctagacaaaggaattaagccttattatcctgaacatgtagttaatcattact<br>tccagacccgacattatttacatactctttggaaggctgggattctatataagagggaaactacacgtag<br>cgcctcatttgcgggtcaccatattcttgggaacaagagctacatcatgggaggttggttaccaaaacc<br>tcgcaaaggcatgggacgaatctgtctgtccccaaccctctgggattctttcccgatcatcagttggac<br>ccagcattcggagccaattcaaacaatccagactgggacttcaaccccacaaaggaccactggccacaag<br>ccaaccaggtaggagtgggagcattcggcccagggttcaccccctccacacggaggtcttttggggtggag<br>ctctcaggctcaaggcacattgcatactgtgccagcagtgcctcctcctgcctccaccaatcggcagtca<br>ggaaggcagcctactcccatctctccacctctaagagacagtcatcctcaggccatgcagtggaa | PLC/PRF/5 Cells (Alexander Cells) Consensus Genome: LC533934.1 (3213 bp) |
| 680 | ggagcaauugaccgggaagcucagaauaaacgcucaacuuuugccggaucuucuagagccaccaugaaccac<br>cgaucaggagauuugaccccccuaaggugguaccaccccgugccagccgagaagaggaagcccauccgcgugc<br>uguccuguucgacggcaucgccacaggccugcuggugcugaaggaucugggcauccagguggacagaua<br>uaucgccuccgaggugugcgaggauucuauccccguggccaugguggaggccaccagggcaagaucaugac<br>gugggcgacgugcgcagcgugacacagaagcacaucaggagugggggaccuuucgaccuggucaucgag<br>gcagcccuguaaugaccuguccaucgugaaccuucgcaaggaagggcccugauggagggaaccggcagacug<br>uucuuugaguucuacaggcugcugcacgacgcccgcccuaaggagggaugacaggcauuuuuuuggc<br>uguuugagaacgugguggccaugggcgugagcgacaagcggggauaucuccagauuccuggagucuaaucc<br>cgugaugaucgaugcaaaggaggugucugccgcacacagggcaagguacuuuggggaaucugccuggc<br>augaaccgcccacuggccagcaccgugaacgacaagcuggagcugcaggagugccuggagcacggaaggau<br>cgccaaguucuccaaggugcggacaaucaccacaagaucuaacagcaucaagcagggcaaggaucagcacuu | HBVg_mRNA_1 |

Sequences

| SEQ ID NO | Sequence | Description |
|---|---|---|
| | ccccguguucaugaaugagaaggaggacauccuguggguguaccgagauggagcgcguguucggcuuucca | |
| | gugcacuauacagacgugagcaauaugagccggcuggcaaggcagagacugcugggccggUccuggucug | |
| | ugccagugaucagacaccuguucgccccccugaaggaguacuuugccugcgugucuagcggcaacucuaau | |
| | gccaacagcagaggcccuuccuuuucucuggccuggugccacugucucugaggggcagccacaugggccc | |
| | cauggagaucuacaagaccgugucc gccuggaagaggcagccugugcgcgugcugucucuguuccgcaaca | |
| | ucgacaaggugcucaagagccugggcuuucuggagagcggauccggaucuggaggaggcaccc ugaagua | |
| | uguggaggaugugacaaaugugguggggagagaugugg agaaguggggcccuucgaucggugu acgg | |
| | auccacccagccacugggaagcuccugcgauaggugucc aggaugguauaugu uccaguu uc acagaaucc | |
| | ugcaguacgcacugccaaggcaggagagccagcgcccuuucuuuuggaucuuuauggacaaccugcugcu | |
| | gacagaggaugaccaggagacaacaacccgcuuccugcagacagaggcagugacccugcaggaugugaggg | |
| | gacgcgacuaucagaaugccaugcggguguggucuaacauccuggccugaaaagcaagcacgccccccug | |
| | accccuaaggaggaggaguaccugcaggcccaggugcggagcagauccaagcuggaugcccuaaggugga | |
| | ccugcugg ugaagaauugucugcc acugcgggguacuucaaguacuuuuagucagaauagccugcca | |
| | cuggaggcaagcggauccgaagggcauccucuggaauccc aggaagcacccgcaaccccaagaagaagcg | |
| | gaaggugggcauccacggcgugcccgccgcgacaagaaguacagcaucggccuggccaucggcaccaaca | |
| | gcgugggcuggccgugaucaccgacgaguacaaggugcccagcaagaaguucaaggugcugggcaacacc | |
| | gaccggcacagcaucaagaagaaccugaucggcgcccugcuguucgacagcggcgagaccgccgugcccc | |
| | cggcugaagcggaccgcccggcggcguacaccggcggaagaaccggaucugcuaccugcaggagaucu | |
| | ucagcaacgagauggccaagguggacgacagcuucuuccaccggcuggaggagagcuuccugguggagga | |
| | ggacaagaagcacgagcggcacccc aucuucggcaacaucguggacgagguggccuaccacgagaaguac | |
| | ccaccaucuaccaccugcggaagaaacguggugacagcaccgacaaggcgaccugcgacgaucuaccug | |
| | gcccuggccacaugaucaaguuccggggccacuuccugaucgagggcgaccugaaccccgacaacagcga | |
| | cguggacaagcuguucauccagcugg ugcagaccuacaaccagcuguucgaggagaaccccaucaacgcca | |
| | gcggcguggacgccaaggccauccugagcgcccggcugagcaagagccggcggcuggagaaccugaucgcc | |
| | cagcugcccggcgagaagaagaacggccuguucggcaaccucaucgcccugagccugggccugacccccaa | |
| | cuucaagagcaacuucgaccuggccgaggacgccaagcugcagcugagcaaggacaccuacgacgacgaccu | |
| | ggacaaccugcuggcccagaucggcgaccaguacgccgaccuguuccuggccgccaagaaccugagcgacg | |
| | ccauccugcugagcgacauccugcgggugaacaccgagaucaccaaggcccccugagcgccagcaugauca | |
| | agcgguacgacgagcaccaccaggaccugacccugcugaaggcccuggugcggcagcagcugcccgagaag | |
| | uacaaggagaucuucuucgaccagagcaagaacggcuacgccggcuacaucgacggcggcgccagccagga | |
| | ggagUucuacaaguucaucaagcccaucc uggagaagauggacggcaccgaggagcugcuggugaagcuga | |
| | accgggaggaccugcugcggaagcagcggaccuucgacaacggcagcauccccaccagauccaccgggc | |
| | gagcugcacgccaucc ugcggcggcaggaggacuucuaccccuuccugaaggacaaccgggagaagaucga | |
| | gaaguccugaccuuccggaucccucuacuacgugggccccgccgcgcugggcacaacagccggguucgccugga | |
| | ugacccggaaaagcgaggagaccaucaccccc uggaacuucgaggagguggugacaagggcgccagcgcc | |
| | cagagcuucaucgagcggaugaccaacuucgacaagaaccugcccaacgagaaggugcugcccaagcacagc | |
| | cugcuguacgaguacuucaccguguacaacgagcugaccaaggugaaguacgugaccgagggcaugcggaa | |
| | gcccgccuuccug agcggcgagcagaaaaggccaucguggaccugcuguucaagaccaaccgcaaggugaca | |
| | ccgugaagcagcugaaggaggacuacuucaagaagaucgagugcuucgacagcguggagaucagcggcgu | |
| | ggaggaccgguucaacgccagccuguggacccuaccacgaccugcugaagaucaucaaggacaaggacuucc | |
| | uggacaacgaggagaacgaggacauccuggaggacaucgugcugacccugaccc uguucgaggaccgggag | |
| | augaucgaggagcggcugaagaccuacgcccaccuguuc gacgacaaggugaugaagcagcugaagcgg | |
| | cgguacaccggcuggggccggcugagccggaagcugaucaacggcauccgggacaagcagagcggcaaga | |
| | ccauccugacuuccugaaaagcgacggcuucgccaaccggaacuucaugcagcugauccacgacgacagcc | |
| | ugaccuucaaggaggacaucagaaggcccaggugagcggccagggcgacagccugcacgagcacaucgcc | |
| | aaccugccgcagccccgccaucaagaagggcauccugcagacgugaagguggugggaucgagcaggcgaa | |
| | ggugaugggccggcacaagcccgagaacauc gugaucgagaugccccgggagaaccagaccacccagaagg | |
| | gccagaagaacagccgggagcggaugaagcggaucgaggaggcauc aaggagcuggcagccagauccug | |
| | aaggagcaccccgguggagaaacccagcugcagaacgagaagcuguaccuguacuaccugcagaacggccg | |
| | ggacauguacguggaccaggagcuggacaucaaccggcugucgacuacgacguggaccgcaucguggccca | |
| | gagcuuccugaaggacgacagcaucgacaacaaggugcugacccggagcgacaagaaccggggcaagagc | |
| | gacaacgugcccagcgaggagguggugaagaagaugaagaacuacuggcggcagcugcugaacgccaagcu | |
| | gaucacccagcggaaguucgacaaccugaccaaggccgagcggggcggccugagcgagcuggacaaggccg | |
| | gcuucaucaagcggcagcuggugugaccggcagaucaccaagcacguggcccagauccuggacagccgg | |
| | augaacaccaagUacgacgaaacgacaagcugauccgggaggugaaggugaucaccc ugaaaagcaagcu | |
| | ggugagcgacuuccggaaggacuuccaguucuacaaggugcgggagaucaacaacuaccaccacgcccacg | |
| | acgccuaccugaacgccguggugggcaccgcccugaucaagaaguaccccaagcuggagagcgaguucgug | |
| | uacggcgacuacaagguguacgacgugcggaagaugaucgccaagagcgagcaggagaucggcaaggccac | |
| | cgccaaguacuucuucuacagcaacaucaugaacuucuucaagaccgagaucacccuggccaacggcgagau | |
| | ccggaagcggcccc ugaucgagaccaacgcgagaccggcgagaucgugugggacaagggccgggacuucg | |
| | ccaccgugcggaaggugcugagcaugccccaggugaacaucgugaagaagaccgaggugcagaccggcggc | |
| | uucagcaaggagagcauccugcccaagcggaacagcgacaagcugaucgcccgaagaaggacugggaccc | |
| | caagaaguacggcggcuucgacagccccaccguggccuacagcgugcugguggugccaagguggagagg | |
| | ggcaagagcaagaaguugaaaagcgugaaggagcuggugggccgcuggugcagcggagcggagcuucga | |
| | gaagaaccccaucgacuuccuggaggcaagggcuacaaggaggugaagaaggaccugaucaucaagcugc | |
| | ccaaguacagccuguucgagcuggaaacgccggaagcggaugcuggccagcgccggcgagcugcagaag | |
| | ggcaacgagcuggcccugccagcaaguacgugaacuucc uguaccuggccagccacuacgagaagcugaa | |
| | gggcagccccgaggacaacgagcagaagcagcuguucguggagcagcacaagcacuaccggacgagauca | |
| | ucgagcagaucagcgaguucagcaagcgggugauccugcacagaacaagugucgagcgcc | |
| | uacaacaagcaccggacaagcccauccgggagcaggccgagaacaucaucccaccuguuc acccugaccaac | |
| | cugggcgcccccgccgccuucaaguacuucgacaccaccaucgaccggaagcgguacaccagcaccaaggag | |
| | gugcuggacgccaccugauccaccagagcauccc ggccuguacgagacccggaucgaccugagccagcu | |
| | gggcggcgacagcggcggcaagcggccgccgccaccaagaaggccggccaagaagaagaaggcua | |
| | gcgaugcuaagucacugacugccuggucccggacacuggugaccuucaaggaugugucuuguggacuucac | |

-continued

| SEQ ID NO | Sequence | Description |
|---|---|---|
| | cagggaggagtggaagcugcuggacacugcucagcagauccuguacagaaaugugaugcuggagaacuau<br>aagaaccugguuccuuggguuaucagcuuacuaagccagaugugauccuccgguuggagaagggagagg<br>aacccuggcugguggagagagaaauucaccaagagacccauccugauucagagacugcauuugaaaucaaa<br>ucaucaguuccgaaaaagaaacgcaaaguuuaguaagaauucaaagaaaguuucuucacauucucucgagc<br>guacgaaaaaaaaaaaaaaaaaaaaaaaaaaaaaaaaaaaaaaaaaaaaaaaaaaaaaaaaaaaaaaaa<br>aaaaaaaaaaaaaaaaaaaaaa<br>aaaaaaaaaaaaa | |
| 681 | ggagcaauugaccgggaagcucagaauaaacgcucaacuuuggccggaucuucuagagccacc | 5' UTR (5U4) |
| 682 | uaguaagaauucaaagaaaguuucuucacauucucucgagcguacg | 3' UTR (3U2) |

SEQUENCE LISTING (1072 sequences)

SEQ ID NO: 1 - DNA, 20 bp, Synthetic construct
  misc_feature 1..20: note = DNA protospacer sequence
  source 1..20: mol_type = other DNA
ccctatcttatcaacacttc

SEQ ID NO: 2 - DNA, 20 bp, Synthetic construct
  misc_feature 1..20: note = DNA protospacer sequence
  source 1..20: mol_type = other DNA
gcagaggtgaaaaagttgca

SEQ ID NO: 3 - DNA, 20 bp, Synthetic construct
  misc_feature 1..20: note = DNA protospacer sequence
  source 1..20: mol_type = other DNA
tggacttctctcaattttct

SEQ ID NO: 4 - DNA, 20 bp, Synthetic construct
  misc_feature 1..20: note = DNA protospacer sequence
  source 1..20: mol_type = other DNA
accccgcctgtaacacgagc

SEQ ID NO: 5 - DNA, 20 bp, Synthetic construct
  misc_feature 1..20: note = DNA protospacer sequence
  source 1..20: mol_type = other DNA
cccgcctgtaacacgagcag

SEQ ID NO: 6 - DNA, 20 bp, Synthetic construct
  misc_feature 1..20: note = DNA protospacer sequence
  source 1..20: mol_type = other DNA
caccacgagtctagactctg

SEQ ID NO: 7 - DNA, 20 bp, Synthetic construct
  misc_feature 1..20: note = DNA protospacer sequence
  source 1..20: mol_type = other DNA
gaggtgaagcgaagtgcaca

SEQ ID NO: 8 - DNA, 20 bp, Synthetic construct
  misc_feature 1..20: note = DNA protospacer sequence
  source 1..20: mol_type = other DNA
ccggaagtgttgataagata

SEQ ID NO: 9 - DNA, 20 bp, Synthetic construct
  misc_feature 1..20: note = DNA protospacer sequence
  source 1..20: mol_type = other DNA
agaagatgaggcatagcagc

SEQ ID NO: 10 - DNA, 20 bp, Synthetic construct
  misc_feature 1..20: note = DNA protospacer sequence
  source 1..20: mol_type = other DNA
tccgcagtatggatcggcag

SEQ ID NO: 11 - DNA, 20 bp, Synthetic construct
  misc_feature 1..20: note = DNA protospacer sequence
  source 1..20: mol_type = other DNA
ggacttctctcaattttcta

SEQ ID NO: 12 - DNA, 20 bp, Synthetic construct
  misc_feature 1..20: note = DNA protospacer sequence
  source 1..20: mol_type = other DNA
ccacccaaggcacagcttgg

SEQ ID NO: 13 - DNA, 20 bp, Synthetic construct
  misc_feature 1..20: note = DNA protospacer sequence
  source 1..20: mol_type = other DNA
agagaggtgcgccccgtggt

SEQ ID NO: 14 - DNA, 20 bp, Synthetic construct
  misc_feature 1..20: note = DNA protospacer sequence
  source 1..20: mol_type = other DNA
gattgagatcttctgcgacg

SEQ ID NO: 15 - DNA, 20 bp, Synthetic construct
  misc_feature 1..20: note = DNA protospacer sequence
  source 1..20: mol_type = other DNA
caagcctccaagctgtgcct

SEQ ID NO: 16 - DNA, 20 bp, Synthetic construct
  misc_feature 1..20: note = DNA protospacer sequence
  source 1..20: mol_type = other DNA
ggcgagggagttcttcttct

SEQ ID NO: 17 - DNA, 20 bp, Synthetic construct
  misc_feature 1..20: note = DNA protospacer sequence
  source 1..20: mol_type = other DNA
tccggaagtgttgataagat

SEQ ID NO: 18 - DNA, 20 bp, Synthetic construct
  misc_feature 1..20: note = DNA protospacer sequence
  source 1..20: mol_type = other DNA
aagccacccaaggcacagct

SEQ ID NO: 19 - DNA, 20 bp, Synthetic construct
  misc_feature 1..20: note = DNA protospacer sequence
  source 1..20: mol_type = other DNA
cctccaagctgtgccttggg

SEQ ID NO: 20 - DNA, 20 bp, Synthetic construct
  misc_feature 1..20: note = DNA protospacer sequence
  source 1..20: mol_type = other DNA
gtaaagagaggtgcgccccg

SEQ ID NO: 21 - DNA, 20 bp, Synthetic construct
  misc_feature 1..20: note = DNA protospacer sequence
  source 1..20: mol_type = other DNA
ggcagatgagaaggcacaga

SEQ ID NO: 22 - DNA, 20 bp, Synthetic construct
  misc_feature 1..20: note = DNA protospacer sequence
  source 1..20: mol_type = other DNA
aggagttccgcagtatggat

SEQ ID NO: 23 - DNA, 20 bp, Synthetic construct
  misc_feature 1..20: note = DNA protospacer sequence
  source 1..20: mol_type = other DNA
gctgtgccttgggtggcttt

SEQ ID NO: 24 - DNA, 20 bp, Synthetic construct
  misc_feature 1..20: note = DNA protospacer sequence
  source 1..20: mol_type = other DNA
acccctgctcgtgttacagg

SEQ ID NO: 25 - DNA, 20 bp, Synthetic construct
  misc_feature 1..20: note = DNA protospacer sequence
  source 1..20: mol_type = other DNA
cggaagtgttgataagatag

SEQ ID NO: 26 - DNA, 20 bp, Synthetic construct
  misc_feature 1..20: note = DNA protospacer sequence
  source 1..20: mol_type = other DNA
cctgctggtggctccagttc

SEQ ID NO: 27 - DNA, 20 bp, Synthetic construct
  misc_feature 1..20: note = DNA protospacer sequence
  source 1..20: mol_type = other DNA
cgagggagttcttcttctag

SEQ ID NO: 28 - DNA, 20 bp, Synthetic construct
  misc_feature 1..20: note = DNA protospacer sequence
  source 1..20: mol_type = other DNA
ggggcgcacctctctttacg

SEQ ID NO: 29 - DNA, 20 bp, Synthetic construct
  misc_feature 1..20: note = DNA protospacer sequence
  source 1..20: mol_type = other DNA
agcttggaggcttgaacagt

SEQ ID NO: 30 - DNA, 20 bp, Synthetic construct
  misc_feature 1..20: note = DNA protospacer sequence
  source 1..20: mol_type = other DNA
aagcctccaagctgtgcctt

SEQ ID NO: 31 - DNA, 20 bp, Synthetic construct
  misc_feature 1..20: note = DNA protospacer sequence
  source 1..20: mol_type = other DNA
cccctgctcgtgttacaggc

SEQ ID NO: 32 - DNA, 20 bp, Synthetic construct
  misc_feature 1..20: note = DNA protospacer sequence
  source 1..20: mol_type = other DNA
gcgagggagttcttcttcta

SEQ ID NO: 33 - DNA, 20 bp, Synthetic construct
  misc_feature 1..20: note = DNA protospacer sequence
  source 1..20: mol_type = other DNA
tactagtgccatttgttcag

SEQ ID NO: 34 - DNA, 20 bp, Synthetic construct
  misc_feature 1..20: note = DNA protospacer sequence
  source 1..20: mol_type = other DNA
gacttctctcaattttctag

SEQ ID NO: 35 - DNA, 20 bp, Synthetic construct
  misc_feature 1..20: note = DNA protospacer sequence
  source 1..20: mol_type = other DNA
attgacccgtataaagaatt

SEQ ID NO: 36 - DNA, 20 bp, Synthetic construct
  misc_feature 1..20: note = DNA protospacer sequence
  source 1..20: mol_type = other DNA
acccaaagacaaaagaaaat

SEQ ID NO: 37 - DNA, 20 bp, Synthetic construct
  misc_feature 1..20: note = DNA protospacer sequence
  source 1..20: mol_type = other DNA
gtcctcttatgtaagacctt

SEQ ID NO: 38 - DNA, 20 bp, Synthetic construct
  misc_feature 1..20: note = DNA protospacer sequence
  source 1..20: mol_type = other DNA
tgatcgggaaagaatcccag

SEQ ID NO: 39 - DNA, 20 bp, Synthetic construct
  misc_feature 1..20: note = DNA protospacer sequence
  source 1..20: mol_type = other DNA
tttgctgacgcaacccccac

SEQ ID NO: 40 - DNA, 20 bp, Synthetic construct
  misc_feature 1..20: note = DNA protospacer sequence
  source 1..20: mol_type = other DNA
atgaatctagccacctgggt

SEQ ID NO: 41 - DNA, 20 bp, Synthetic construct
  misc_feature 1..20: note = DNA protospacer sequence
  source 1..20: mol_type = other DNA
ggtctccatgcgacgtgcag

SEQ ID NO: 42 - DNA, 20 bp, Synthetic construct
  misc_feature 1..20: note = DNA protospacer sequence
  source 1..20: mol_type = other DNA
ggactgaggcccactcccat

SEQ ID NO: 43 - DNA, 20 bp, Synthetic construct
  misc_feature 1..20: note = DNA protospacer sequence
  source 1..20: mol_type = other DNA
cacagagtctagactcgtgg

SEQ ID NO: 44 - DNA, 20 bp, Synthetic construct
  misc_feature 1..20: note = DNA protospacer sequence
  source 1..20: mol_type = other DNA
gaagaaccaacaagaagatg

SEQ ID NO: 45 - DNA, 20 bp, Synthetic construct
  misc_feature 1..20: note = DNA protospacer sequence
  source 1..20: mol_type = other DNA
acacggtccggcagatgaga

SEQ ID NO: 46 - DNA, 20 bp, Synthetic construct
  misc_feature 1..20: note = DNA protospacer sequence
  source 1..20: mol_type = other DNA
gacatgaacatgagatgatt

SEQ ID NO: 47 - DNA, 20 bp, Synthetic construct
  misc_feature 1..20: note = DNA protospacer sequence
  source 1..20: mol_type = other DNA
gcagcacagcctagcagcca

SEQ ID NO: 48 - DNA, 20 bp, Synthetic construct
  misc_feature 1..20: note = DNA protospacer sequence
  source 1..20: mol_type = other DNA
tcctggaattagaggacaaa

SEQ ID NO: 49 - DNA, 20 bp, Synthetic construct
  misc_feature 1..20: note = DNA protospacer sequence
  source 1..20: mol_type = other DNA
gtcttacataagaggactct

SEQ ID NO: 50 - DNA, 20 bp, Synthetic construct
  misc_feature 1..20: note = DNA protospacer sequence
  source 1..20: mol_type = other DNA
ttgtgggtcaccatattctt

SEQ ID NO: 51 - DNA, 20 bp, Synthetic construct
  misc_feature 1..20: note = DNA protospacer sequence
  source 1..20: mol_type = other DNA
cgcaaaatacctatgggagt

SEQ ID NO: 52 - DNA, 20 bp, Synthetic construct
  misc_feature 1..20: note = DNA protospacer sequence
  source 1..20: mol_type = other DNA
gggttgcgtcagcaaacact

SEQ ID NO: 53 - DNA, 20 bp, Synthetic construct
  misc_feature 1..20: note = DNA protospacer sequence
  source 1..20: mol_type = other DNA
agctcttgttcccaagaata

SEQ ID NO: 54 - DNA, 20 bp, Synthetic construct
  misc_feature 1..20: note = DNA protospacer sequence
  source 1..20: mol_type = other DNA
tgacatactttccaatcaat

SEQ ID NO: 55 - DNA, 20 bp, Synthetic construct
  misc_feature 1..20: note = DNA protospacer sequence
  source 1..20: mol_type = other DNA
cagatgagaaggcacagacg

SEQ ID NO: 56 - DNA, 20 bp, Synthetic construct
  misc_feature 1..20: note = DNA protospacer sequence
  source 1..20: mol_type = other DNA
ccccgcctgtaacacgagca

SEQ ID NO: 57 - DNA, 20 bp, Synthetic construct
  misc_feature 1..20: note = DNA protospacer sequence
  source 1..20: mol_type = other DNA
gggtggagccctcaggctca

SEQ ID NO: 58 - DNA, 20 bp, Synthetic construct
  misc_feature 1..20: note = DNA protospacer sequence
  source 1..20: mol_type = other DNA
attccttggactcataaggt

SEQ ID NO: 59 - DNA, 20 bp, Synthetic construct
  misc_feature 1..20: note = DNA protospacer sequence
  source 1..20: mol_type = other DNA
tttgtgggtcaccatattct

SEQ ID NO: 60 - DNA, 20 bp, Synthetic construct
  misc_feature 1..20: note = DNA protospacer sequence
  source 1..20: mol_type = other DNA
gtgaaaaagttgcatggtgc

SEQ ID NO: 61 - DNA, 20 bp, Synthetic construct
  misc_feature 1..20: note = DNA protospacer sequence
  source 1..20: mol_type = other DNA
cctgaactggagccaccagc

SEQ ID NO: 62 - DNA, 20 bp, Synthetic construct
  misc_feature 1..20: note = DNA protospacer sequence
  source 1..20: mol_type = other DNA
tcctctgccgatccatactg

SEQ ID NO: 63 - DNA, 20 bp, Synthetic construct
  misc_feature 1..20: note = DNA protospacer sequence
  source 1..20: mol_type = other DNA
cggctaggagttccgcagta

SEQ ID NO: 64 - DNA, 20 bp, Synthetic construct
  misc_feature 1..20: note = DNA protospacer sequence
  source 1..20: mol_type = other DNA
aatgtcaacgaccgaccttg

SEQ ID NO: 65 - DNA, 20 bp, Synthetic construct
  misc_feature 1..20: note = DNA protospacer sequence
  source 1..20: mol_type = other DNA
gaccttcgtctgcgaggcga

SEQ ID NO: 66 - DNA, 20 bp, Synthetic construct
  misc_feature 1..20: note = DNA protospacer sequence
  source 1..20: mol_type = other DNA
gttgccgggcaacggggtaa

SEQ ID NO: 67 - DNA, 20 bp, Synthetic construct
  misc_feature 1..20: note = DNA protospacer sequence
  source 1..20: mol_type = other DNA
gattgagaccttcgtctgcg

SEQ ID NO: 68 - DNA, 20 bp, Synthetic construct
  misc_feature 1..20: note = DNA protospacer sequence
  source 1..20: mol_type = other DNA
aggacccctgctcgtgttac

SEQ ID NO: 69 - DNA, 20 bp, Synthetic construct
  misc_feature 1..20: note = DNA protospacer sequence
  source 1..20: mol_type = other DNA
tttgaagtatgcctcaaggt

SEQ ID NO: 70 - DNA, 20 bp, Synthetic construct
  misc_feature 1..20: note = DNA protospacer sequence
  source 1..20: mol_type = other DNA
ccgcttgttttgctcgcagc

SEQ ID NO: 71 - DNA, 20 bp, Synthetic construct
  misc_feature 1..20: note = DNA protospacer sequence
  source 1..20: mol_type = other DNA
tgctaggctgtgctgccaac

SEQ ID NO: 72 - DNA, 20 bp, Synthetic construct
  misc_feature 1..20: note = DNA protospacer sequence
  source 1..20: mol_type = other DNA
tgccgattggtggaggcagg

SEQ ID NO: 73 - DNA, 20 bp, Synthetic construct
  misc_feature 1..20: note = DNA protospacer sequence
  source 1..20: mol_type = other DNA
tctttgtactaggaggctgt

SEQ ID NO: 74 - DNA, 20 bp, Synthetic construct
  misc_feature 1..20: note = DNA protospacer sequence
  source 1..20: mol_type = other DNA
cgtcccgcgcaggatccagt

SEQ ID NO: 75 - DNA, 20 bp, Synthetic construct
  misc_feature 1..20: note = DNA protospacer sequence
  source 1..20: mol_type = other DNA
aaagcccaagatgatgggat

SEQ ID NO: 76 - DNA, 20 bp, Synthetic construct
  misc_feature 1..20: note = DNA protospacer sequence
  source 1..20: mol_type = other DNA
gcagatgagaaggcacagac

SEQ ID NO: 77 - DNA, 20 bp, Synthetic construct
  misc_feature 1..20: note = DNA protospacer sequence
  source 1..20: mol_type = other DNA
cgattggtggaggcaggagg

SEQ ID NO: 78 - DNA, 20 bp, Synthetic construct
  misc_feature 1..20: note = DNA protospacer sequence
  source 1..20: mol_type = other DNA
aggaggctgtaggcataaat

SEQ ID NO: 79 - DNA, 20 bp, Synthetic construct
  misc_feature 1..20: note = DNA protospacer sequence
  source 1..20: mol_type = other DNA
ccatgccccaaagccaccca

SEQ ID NO: 80 - DNA, 20 bp, Synthetic construct
  misc_feature 1..20: note = DNA protospacer sequence
  source 1..20: mol_type = other DNA
aggttggggactgcgaattt

SEQ ID NO: 81 - DNA, 20 bp, Synthetic construct
  misc_feature 1..20: note = DNA protospacer sequence
  source 1..20: mol_type = other DNA
agaccttcgtctgcgaggcg

SEQ ID NO: 82 - DNA, 20 bp, Synthetic construct
  misc_feature 1..20: note = DNA protospacer sequence
  source 1..20: mol_type = other DNA
cctggaattagaggacaaac

SEQ ID NO: 83 - DNA, 20 bp, Synthetic construct
  misc_feature 1..20: note = DNA protospacer sequence
  source 1..20: mol_type = other DNA
tttcagttatatggatgatg

SEQ ID NO: 84 - DNA, 20 bp, Synthetic construct
  misc_feature 1..20: note = DNA protospacer sequence
  source 1..20: mol_type = other DNA
gtaacacgagcaggggtcct

SEQ ID NO: 85 - DNA, 20 bp, Synthetic construct
  misc_feature 1..20: note = DNA protospacer sequence
  source 1..20: mol_type = other DNA
catcttcttgttggttcttc

SEQ ID NO: 86 - DNA, 20 bp, Synthetic construct
  misc_feature 1..20: note = DNA protospacer sequence
  source 1..20: mol_type = other DNA
cggggagaccgcgtaaagag

SEQ ID NO: 87 - DNA, 20 bp, Synthetic construct
  misc_feature 1..20: note = DNA protospacer sequence
  source 1..20: mol_type = other DNA
ctagactctgtggtattgtg

SEQ ID NO: 88 - DNA, 20 bp, Synthetic construct
  misc_feature 1..20: note = DNA protospacer sequence
  source 1..20: mol_type = other DNA
ccctgctcgtgttacaggcg

SEQ ID NO: 89 - DNA, 20 bp, Synthetic construct
  misc_feature 1..20: note = DNA protospacer sequence
  source 1..20: mol_type = other DNA
taccacagagtctagactcg

SEQ ID NO: 90 - DNA, 20 bp, Synthetic construct
  misc_feature 1..20: note = DNA protospacer sequence
  source 1..20: mol_type = other DNA
tcgcaaaatacctatgggag

SEQ ID NO: 91 - DNA, 20 bp, Synthetic construct
  misc_feature 1..20: note = DNA protospacer sequence
  source 1..20: mol_type = other DNA
gtctgtgccttctcatctgc

SEQ ID NO: 92 - DNA, 20 bp, Synthetic construct
  misc_feature 1..20: note = DNA protospacer sequence
  source 1..20: mol_type = other DNA
acacgtagcgcctcattttg

SEQ ID NO: 93 - DNA, 20 bp, Synthetic construct
  misc_feature 1..20: note = DNA protospacer sequence
  source 1..20: mol_type = other DNA
ttggggttgaggtcccaatc

SEQ ID NO: 94 - DNA, 20 bp, Synthetic construct
  misc_feature 1..20: note = DNA protospacer sequence
  source 1..20: mol_type = other DNA
ccccgagacgggtcgtccgc

SEQ ID NO: 95 - DNA, 20 bp, Synthetic construct
  misc_feature 1..20: note = DNA protospacer sequence
  source 1..20: mol_type = other DNA
cctacgaaccactgaacaaa

SEQ ID NO: 96 - DNA, 20 bp, Synthetic construct
  misc_feature 1..20: note = DNA protospacer sequence
  source 1..20: mol_type = other DNA
ttacatactctgtggaaggc

SEQ ID NO: 97 - DNA, 20 bp, Synthetic construct
  misc_feature 1..20: note = DNA protospacer sequence
  source 1..20: mol_type = other DNA
acctcctttccatggctgct

SEQ ID NO: 98 - DNA, 20 bp, Synthetic construct
  misc_feature 1..20: note = DNA protospacer sequence
  source 1..20: mol_type = other DNA
gttatcgctggatgtgtctg

SEQ ID NO: 99 - DNA, 20 bp, Synthetic construct
  misc_feature 1..20: note = DNA protospacer sequence
  source 1..20: mol_type = other DNA
aacatgagatgattaggcag

SEQ ID NO: 100 - DNA, 20 bp, Synthetic construct
  misc_feature 1..20: note = DNA protospacer sequence
  source 1..20: mol_type = other DNA
acttctctcaattttctagg

SEQ ID NO: 101 - DNA, 20 bp, Synthetic construct
  misc_feature 1..20: note = DNA protospacer sequence
  source 1..20: mol_type = other DNA
cactttctcgccaacttaca

SEQ ID NO: 102 - DNA, 20 bp, Synthetic construct
  misc_feature 1..20: note = DNA protospacer sequence
  source 1..20: mol_type = other DNA
cataaggtgggaaactttac

SEQ ID NO: 103 - DNA, 20 bp, Synthetic construct
  misc_feature 1..20: note = DNA protospacer sequence
  source 1..20: mol_type = other DNA
ccaaacctcgaaaaggcatg

SEQ ID NO: 104 - DNA, 20 bp, Synthetic construct
  misc_feature 1..20: note = DNA protospacer sequence
  source 1..20: mol_type = other DNA
atagaaggaaagaagtcaga

SEQ ID NO: 105 - DNA, 20 bp, Synthetic construct
  misc_feature 1..20: note = DNA protospacer sequence
  source 1..20: mol_type = other DNA
gctgctccttttacacaatg

SEQ ID NO: 106 - DNA, 20 bp, Synthetic construct
  misc_feature 1..20: note = DNA protospacer sequence
  source 1..20: mol_type = other DNA
gaagcgaagtgcacacggtc

SEQ ID NO: 107 - DNA, 20 bp, Synthetic construct
  misc_feature 1..20: note = DNA protospacer sequence
  source 1..20: mol_type = other DNA
ggatcatcaaccaccagcac

SEQ ID NO: 108 - DNA, 20 bp, Synthetic construct
  misc_feature 1..20: note = DNA protospacer sequence
  source 1..20: mol_type = other DNA
gagccaagagaaacggactg

SEQ ID NO: 109 - DNA, 20 bp, Synthetic construct
  misc_feature 1..20: note = DNA protospacer sequence
  source 1..20: mol_type = other DNA
cttcacctctgcacgtcgca

SEQ ID NO: 110 - DNA, 20 bp, Synthetic construct
  misc_feature 1..20: note = DNA protospacer sequence
  source 1..20: mol_type = other DNA
acaatgttccggagactcta

SEQ ID NO: 111 - DNA, 20 bp, Synthetic construct
  misc_feature 1..20: note = DNA protospacer sequence
  source 1..20: mol_type = other DNA
tccgcgggattcagcgccga

SEQ ID NO: 112 - DNA, 20 bp, Synthetic construct
  misc_feature 1..20: note = DNA protospacer sequence
  source 1..20: mol_type = other DNA
ttaatgagtgggaggagttg

SEQ ID NO: 113 - DNA, 20 bp, Synthetic construct
  misc_feature 1..20: note = DNA protospacer sequence
  source 1..20: mol_type = other DNA
ccaactcaaacaatccagat

SEQ ID NO: 114 - DNA, 20 bp, Synthetic construct
  misc_feature 1..20: note = DNA protospacer sequence
  source 1..20: mol_type = other DNA
gctgccaactggatcctgcg

SEQ ID NO: 115 - DNA, 20 bp, Synthetic construct
  misc_feature 1..20: note = DNA protospacer sequence
  source 1..20: mol_type = other DNA
agtctttgaagtatgcctca

SEQ ID NO: 116 - DNA, 20 bp, Synthetic construct
  misc_feature 1..20: note = DNA protospacer sequence
  source 1..20: mol_type = other DNA
tcctgactgccgattggtgg

SEQ ID NO: 117 - DNA, 20 bp, Synthetic construct
  misc_feature 1..20: note = DNA protospacer sequence
  source 1..20: mol_type = other DNA
tcttgtcctccaatttgtcc

SEQ ID NO: 118 - DNA, 20 bp, Synthetic construct
  misc_feature 1..20: note = DNA protospacer sequence
  source 1..20: mol_type = other DNA
cgataaccaggacaaattgg

SEQ ID NO: 119 - DNA, 20 bp, Synthetic construct
  misc_feature 1..20: note = DNA protospacer sequence
  source 1..20: mol_type = other DNA
atttggaagatccagcatcc

SEQ ID NO: 120 - DNA, 20 bp, Synthetic construct
  misc_feature 1..20: note = DNA protospacer sequence
  source 1..20: mol_type = other DNA
ctgtttggctttcagttata

SEQ ID NO: 121 - DNA, 20 bp, Synthetic construct
  misc_feature 1..20: note = DNA protospacer sequence
  source 1..20: mol_type = other DNA
ctcctcctgcctccaccaat

SEQ ID NO: 122 - DNA, 20 bp, Synthetic construct
  misc_feature 1..20: note = DNA protospacer sequence
  source 1..20: mol_type = other DNA
gtcatcctcaggccatgcag

SEQ ID NO: 123 - DNA, 20 bp, Synthetic construct
  misc_feature 1..20: note = DNA protospacer sequence
  source 1..20: mol_type = other DNA
ctgccgttccggccgaccac

SEQ ID NO: 124 - DNA, 20 bp, Synthetic construct
  misc_feature 1..20: note = DNA protospacer sequence
  source 1..20: mol_type = other DNA
ccttcctgactgccgattgg

SEQ ID NO: 125 - DNA, 20 bp, Synthetic construct
  misc_feature 1..20: note = DNA protospacer sequence
  source 1..20: mol_type = other DNA
acctgcacgactcctgctca

SEQ ID NO: 126 - DNA, 20 bp, Synthetic construct
  misc_feature 1..20: note = DNA protospacer sequence
  source 1..20: mol_type = other DNA
ggcctgtattttcctgctgg

SEQ ID NO: 127 - DNA, 20 bp, Synthetic construct
  misc_feature 1..20: note = DNA protospacer sequence
  source 1..20: mol_type = other DNA
aacatagaggttccttgagc

SEQ ID NO: 128 - DNA, 20 bp, Synthetic construct
  misc_feature 1..20: note = DNA protospacer sequence
  source 1..20: mol_type = other DNA
tgccgttccggccgaccacg

SEQ ID NO: 129 - DNA, 20 bp, Synthetic construct
  misc_feature 1..20: note = DNA protospacer sequence
  source 1..20: mol_type = other DNA
ataggccatcagcgcatgcg

SEQ ID NO: 130 - DNA, 20 bp, Synthetic construct
  misc_feature 1..20: note = DNA protospacer sequence
  source 1..20: mol_type = other DNA
gcctccaccaatcggcagtc

SEQ ID NO: 131 - DNA, 20 bp, Synthetic construct
  misc_feature 1..20: note = DNA protospacer sequence
  source 1..20: mol_type = other DNA
gtcctttgtttacgtcccgt

SEQ ID NO: 132 - DNA, 20 bp, Synthetic construct
  misc_feature 1..20: note = DNA protospacer sequence
  source 1..20: mol_type = other DNA
tgggaacaagagctacagca

SEQ ID NO: 133 - DNA, 20 bp, Synthetic construct
  misc_feature 1..20: note = DNA protospacer sequence
  source 1..20: mol_type = other DNA
ctgtaaacaggcctattgat

SEQ ID NO: 134 - DNA, 20 bp, Synthetic construct
  misc_feature 1..20: note = DNA protospacer sequence
  source 1..20: mol_type = other DNA
gtcgcagaagatctcaatct

SEQ ID NO: 135 - DNA, 20 bp, Synthetic construct
  misc_feature 1..20: note = DNA protospacer sequence
  source 1..20: mol_type = other DNA
ctgccttcctgactgccgat

SEQ ID NO: 136 - DNA, 20 bp, Synthetic construct
  misc_feature 1..20: note = DNA protospacer sequence
  source 1..20: mol_type = other DNA
actactaattccctggatgc

SEQ ID NO: 137 - DNA, 20 bp, Synthetic construct
  misc_feature 1..20: note = DNA protospacer sequence
  source 1..20: mol_type = other DNA
cacatttcttgccttacttt

SEQ ID NO: 138 - DNA, 20 bp, Synthetic construct
  misc_feature 1..20: note = DNA protospacer sequence
  source 1..20: mol_type = other DNA
ggatgactgtctcttagagg

SEQ ID NO: 139 - DNA, 20 bp, Synthetic construct
  misc_feature 1..20: note = DNA protospacer sequence
  source 1..20: mol_type = other DNA
gctatgcctcatcttcttgt

SEQ ID NO: 140 - DNA, 20 bp, Synthetic construct
  misc_feature 1..20: note = DNA protospacer sequence
  source 1..20: mol_type = other DNA
cccgtcggcgctgaatcccg

SEQ ID NO: 141 - DNA, 20 bp, Synthetic construct
  misc_feature 1..20: note = DNA protospacer sequence
  source 1..20: mol_type = other DNA
tagtattccttggactcata

SEQ ID NO: 142 - DNA, 20 bp, Synthetic construct
  misc_feature 1..20: note = DNA protospacer sequence
  source 1..20: mol_type = other DNA
aggtaggagcgggagcattc

SEQ ID NO: 143 - DNA, 20 bp, Synthetic construct
  misc_feature 1..20: note = DNA protospacer sequence
  source 1..20: mol_type = other DNA
tcttttggggtggagccctc

SEQ ID NO: 144 - DNA, 20 bp, Synthetic construct
  misc_feature 1..20: note = DNA protospacer sequence
  source 1..20: mol_type = other DNA
tcagtatgccctgagcctga

SEQ ID NO: 145 - DNA, 20 bp, Synthetic construct
  misc_feature 1..20: note = DNA protospacer sequence
  source 1..20: mol_type = other DNA
tttaatgagtgggaggagtt

SEQ ID NO: 146 - DNA, 20 bp, Synthetic construct
  misc_feature 1..20: note = DNA protospacer sequence
  source 1..20: mol_type = other DNA
ctccctcgcctcgcagacga

SEQ ID NO: 147 - DNA, 20 bp, Synthetic construct
  misc_feature 1..20: note = DNA protospacer sequence
  source 1..20: mol_type = other DNA
gataagataggggcatttgg

SEQ ID NO: 148 - DNA, 20 bp, Synthetic construct
  misc_feature 1..20: note = DNA protospacer sequence
  source 1..20: mol_type = other DNA
ccgcgggattcagcgccgac

SEQ ID NO: 149 - DNA, 20 bp, Synthetic construct
  misc_feature 1..20: note = DNA protospacer sequence
  source 1..20: mol_type = other DNA
cagcgataaccaggacaaat

SEQ ID NO: 150 - DNA, 20 bp, Synthetic construct
  misc_feature 1..20: note = DNA protospacer sequence
  source 1..20: mol_type = other DNA
caggtaggagtgggagcatt

SEQ ID NO: 151 - DNA, 20 bp, Synthetic construct
  misc_feature 1..20: note = DNA protospacer sequence
  source 1..20: mol_type = other DNA
gtttaatgagtgggaggagt

SEQ ID NO: 152 - DNA, 20 bp, Synthetic construct
  misc_feature 1..20: note = DNA protospacer sequence
  source 1..20: mol_type = other DNA
tggtgagtgattggaggttg

SEQ ID NO: 153 - DNA, 20 bp, Synthetic construct
  misc_feature 1..20: note = DNA protospacer sequence
  source 1..20: mol_type = other DNA
taatgagtgggaggagttgg

SEQ ID NO: 154 - DNA, 20 bp, Synthetic construct
  misc_feature 1..20: note = DNA protospacer sequence
  source 1..20: mol_type = other DNA
actacatgttctggataata

SEQ ID NO: 155 - DNA, 20 bp, Synthetic construct
  misc_feature 1..20: note = DNA protospacer sequence
  source 1..20: mol_type = other DNA
ggcatagcagcaggatgaag

SEQ ID NO: 156 - DNA, 20 bp, Synthetic construct
  misc_feature 1..20: note = DNA protospacer sequence
  source 1..20: mol_type = other DNA
gttgataagataggggcatt

SEQ ID NO: 157 - DNA, 20 bp, Synthetic construct
  misc_feature 1..20: note = DNA protospacer sequence
  source 1..20: mol_type = other DNA
tcaacgaattgtgggtcttt

SEQ ID NO: 158 - DNA, 20 bp, Synthetic construct
  misc_feature 1..20: note = DNA protospacer sequence
  source 1..20: mol_type = other DNA
tatggatgatgtggtattgg

SEQ ID NO: 159 - DNA, 20 bp, Synthetic construct
  misc_feature 1..20: note = DNA protospacer sequence
  source 1..20: mol_type = other DNA
caacgaattgtgggtctttt

SEQ ID NO: 160 - DNA, 20 bp, Synthetic construct
  misc_feature 1..20: note = DNA protospacer sequence
  source 1..20: mol_type = other DNA
catttgttcagtggttcgta

SEQ ID NO: 161 - DNA, 20 bp, Synthetic construct
  misc_feature 1..20: note = DNA protospacer sequence
  source 1..20: mol_type = other DNA
cgtctaacaacagtagtttc

SEQ ID NO: 162 - DNA, 20 bp, Synthetic construct
  misc_feature 1..20: note = DNA protospacer sequence
  source 1..20: mol_type = other DNA
tgcctgagtgctgtatggtg

SEQ ID NO: 163 - DNA, 20 bp, Synthetic construct
  misc_feature 1..20: note = DNA protospacer sequence
  source 1..20: mol_type = other DNA
gccccgagacgggtcgtccg

SEQ ID NO: 164 - DNA, 20 bp, Synthetic construct
  misc_feature 1..20: note = DNA protospacer sequence
  source 1..20: mol_type = other DNA
gactgccgattggtggaggc

SEQ ID NO: 165 - DNA, 20 bp, Synthetic construct
  misc_feature 1..20: note = DNA protospacer sequence
  source 1..20: mol_type = other DNA
tatatggatgatgtggtatt

SEQ ID NO: 166 - DNA, 20 bp, Synthetic construct
  misc_feature 1..20: note = DNA protospacer sequence
  source 1..20: mol_type = other DNA
cttgagtatttggtgtcttt

SEQ ID NO: 167 - DNA, 20 bp, Synthetic construct
  misc_feature 1..20: note = DNA protospacer sequence
  source 1..20: mol_type = other DNA
gatctggtgggcgttcacgg

SEQ ID NO: 168 - DNA, 20 bp, Synthetic construct
  misc_feature 1..20: note = DNA protospacer sequence
  source 1..20: mol_type = other DNA
agactgggaggagttggggg

SEQ ID NO: 169 - DNA, 20 bp, Synthetic construct
  misc_feature 1..20: note = DNA protospacer sequence
  source 1..20: mol_type = other DNA
agtcctcttatgtaagacct

SEQ ID NO: 170 - DNA, 20 bp, Synthetic construct
  misc_feature 1..20: note = DNA protospacer sequence
  source 1..20: mol_type = other DNA
ctcaagatgttgtacagact

SEQ ID NO: 171 - DNA, 20 bp, Synthetic construct
  misc_feature 1..20: note = DNA protospacer sequence
  source 1..20: mol_type = other DNA
gggaacaagagctacagcat

SEQ ID NO: 172 - DNA, 20 bp, Synthetic construct
  misc_feature 1..20: note = DNA protospacer sequence
  source 1..20: mol_type = other DNA
tcgcagaagatctcaatctc

SEQ ID NO: 173 - DNA, 20 bp, Synthetic construct
  misc_feature 1..20: note = DNA protospacer sequence
  source 1..20: mol_type = other DNA
ggggtggagccctcaggctc

SEQ ID NO: 174 - DNA, 20 bp, Synthetic construct
  misc_feature 1..20: note = DNA protospacer sequence
  source 1..20: mol_type = other DNA
tattccttggactcataagg

SEQ ID NO: 175 - DNA, 20 bp, Synthetic construct
  misc_feature 1..20: note = DNA protospacer sequence
  source 1..20: mol_type = other DNA
tctaagagacagtcatcctc

SEQ ID NO: 176 - DNA, 20 bp, Synthetic construct
  misc_feature 1..20: note = DNA protospacer sequence
  source 1..20: mol_type = other DNA
caactcaaacaatccagatt

SEQ ID NO: 177 - DNA, 20 bp, Synthetic construct
  misc_feature 1..20: note = DNA protospacer sequence
  source 1..20: mol_type = other DNA
aaacaaaggacgtcccgcgc

SEQ ID NO: 178 - DNA, 20 bp, Synthetic construct
  misc_feature 1..20: note = DNA protospacer sequence
  source 1..20: mol_type = other DNA
ctgccaactggatcctgcgc

SEQ ID NO: 179 - DNA, 20 bp, Synthetic construct
  misc_feature 1..20: note = DNA protospacer sequence
  source 1..20: mol_type = other DNA
gaagctccaaattctttata

SEQ ID NO: 180 - DNA, 20 bp, Synthetic construct
  misc_feature 1..20: note = DNA protospacer sequence
  source 1..20: mol_type = other DNA
gtcagtatgccctgagcctg

SEQ ID NO: 181 - DNA, 20 bp, Synthetic construct
  misc_feature 1..20: note = DNA protospacer sequence
  source 1..20: mol_type = other DNA
tttcccaccttatgagtcca

SEQ ID NO: 182 - DNA, 20 bp, Synthetic construct
  misc_feature 1..20: note = DNA protospacer sequence
  source 1..20: mol_type = other DNA
acaagaggttggtgagtgat

SEQ ID NO: 183 - DNA, 20 bp, Synthetic construct
  misc_feature 1..20: note = DNA protospacer sequence
  source 1..20: mol_type = other DNA
gaaagcccaagatgatggga

SEQ ID NO: 184 - DNA, 20 bp, Synthetic construct
  misc_feature 1..20: note = DNA protospacer sequence
  source 1..20: mol_type = other DNA
aggttccacgcatgcgctga

SEQ ID NO: 185 - DNA, 20 bp, Synthetic construct
  misc_feature 1..20: note = DNA protospacer sequence
  source 1..20: mol_type = other DNA
ttggtgagtgattggaggtt

SEQ ID NO: 186 - DNA, 20 bp, Synthetic construct
  misc_feature 1..20: note = DNA protospacer sequence
  source 1..20: mol_type = other DNA
agagctacagcatgggaggt

SEQ ID NO: 187 - DNA, 20 bp, Synthetic construct
  misc_feature 1..20: note = DNA protospacer sequence
  source 1..20: mol_type = other DNA
atatggatgatgtggtattg

SEQ ID NO: 188 - DNA, 20 bp, Synthetic construct
  misc_feature 1..20: note = DNA protospacer sequence
  source 1..20: mol_type = other DNA
ccatttgttcagtggttcgt

SEQ ID NO: 189 - DNA, 20 bp, Synthetic construct
  misc_feature 1..20: note = DNA protospacer sequence
  source 1..20: mol_type = other DNA
ttatatggatgatgtggtat

SEQ ID NO: 190 - DNA, 20 bp, Synthetic construct
  misc_feature 1..20: note = DNA protospacer sequence
  source 1..20: mol_type = other DNA
ggagtgggagcattcgggcc

SEQ ID NO: 191 - DNA, 20 bp, Synthetic construct
  misc_feature 1..20: note = DNA protospacer sequence
  source 1..20: mol_type = other DNA
atttggtgtcttttggagtg

SEQ ID NO: 192 - DNA, 20 bp, Synthetic construct
  misc_feature 1..20: note = DNA protospacer sequence
  source 1..20: mol_type = other DNA
cacagaaaggccttgtaagt

SEQ ID NO: 193 - DNA, 20 bp, Synthetic construct
  misc_feature 1..20: note = DNA protospacer sequence
  source 1..20: mol_type = other DNA
accaattttcttttgtcttt

SEQ ID NO: 194 - DNA, 20 bp, Synthetic construct
  misc_feature 1..20: note = DNA protospacer sequence
  source 1..20: mol_type = other DNA
aggttaatggtctttgtact

SEQ ID NO: 195 - DNA, 20 bp, Synthetic construct
  misc_feature 1..20: note = DNA protospacer sequence
  source 1..20: mol_type = other DNA
taccaattttcttttgtctt

SEQ ID NO: 196 - RNA, 20 nt, Synthetic construct
  misc_feature 1..20: note = RNA protospacer sequence
  source 1..20: mol_type = other RNA
ccctatcttatcaacacttc

SEQ ID NO: 197 - RNA, 20 nt, Synthetic construct
  misc_feature 1..20: note = RNA protospacer sequence
  source 1..20: mol_type = other RNA
gcagaggtgaaaaagttgca

SEQ ID NO: 198 - RNA, 20 nt, Synthetic construct
  misc_feature 1..20: note = RNA protospacer sequence
  source 1..20: mol_type = other RNA
tggacttctctcaattttct

SEQ ID NO: 199 - RNA, 20 nt, Synthetic construct
  misc_feature 1..20: note = RNA protospacer sequence
  source 1..20: mol_type = other RNA
accccgcctgtaacacgagc

SEQ ID NO: 200 - RNA, 20 nt, Synthetic construct
  misc_feature 1..20: note = RNA protospacer sequence
  source 1..20: mol_type = other RNA
cccgcctgtaacacgagcag

SEQ ID NO: 201 - RNA, 20 nt, Synthetic construct
  misc_feature 1..20: note = RNA protospacer sequence
  source 1..20: mol_type = other RNA
caccacgagtctagactctg

SEQ ID NO: 202 - RNA, 20 nt, Synthetic construct
  misc_feature 1..20: note = RNA protospacer sequence
  source 1..20: mol_type = other RNA
gaggtgaagcgaagtgcaca

SEQ ID NO: 203 - RNA, 20 nt, Synthetic construct
  misc_feature 1..20: note = RNA protospacer sequence
  source 1..20: mol_type = other RNA
ccggaagtgttgataagata

SEQ ID NO: 204 - RNA, 20 nt, Synthetic construct
  misc_feature 1..20: note = RNA protospacer sequence
  source 1..20: mol_type = other RNA
agaagatgaggcatagcagc

SEQ ID NO: 205 - RNA, 20 nt, Synthetic construct
  misc_feature 1..20: note = RNA protospacer sequence
  source 1..20: mol_type = other RNA
tccgcagtatggatcggcag

SEQ ID NO: 206 - RNA, 20 nt, Synthetic construct
  misc_feature 1..20: note = RNA protospacer sequence
  source 1..20: mol_type = other RNA
ggacttctctcaattttcta

SEQ ID NO: 207 - RNA, 20 nt, Synthetic construct
  misc_feature 1..20: note = RNA protospacer sequence
  source 1..20: mol_type = other RNA
ccacccaaggcacagcttgg

SEQ ID NO: 208 - RNA, 20 nt, Synthetic construct
  misc_feature 1..20: note = RNA protospacer sequence
  source 1..20: mol_type = other RNA
agagaggtgcgccccgtggt

SEQ ID NO: 209 - RNA, 20 nt, Synthetic construct
  misc_feature 1..20: note = RNA protospacer sequence
  source 1..20: mol_type = other RNA
gattgagatcttctgcgacg

SEQ ID NO: 210 - RNA, 20 nt, Synthetic construct
  misc_feature 1..20: note = RNA protospacer sequence
  source 1..20: mol_type = other RNA
caagcctccaagctgtgcct

SEQ ID NO: 211 - RNA, 20 nt, Synthetic construct
  misc_feature 1..20: note = RNA protospacer sequence
  source 1..20: mol_type = other RNA
ggcgagggagttcttcttct

SEQ ID NO: 212 - RNA, 20 nt, Synthetic construct
  misc_feature 1..20: note = RNA protospacer sequence
  source 1..20: mol_type = other RNA
tccggaagtgttgataagat

SEQ ID NO: 213 - RNA, 20 nt, Synthetic construct
  misc_feature 1..20: note = RNA protospacer sequence
  source 1..20: mol_type = other RNA
aagccacccaaggcacagct

SEQ ID NO: 214 - RNA, 20 nt, Synthetic construct
  misc_feature 1..20: note = RNA protospacer sequence
  source 1..20: mol_type = other RNA
cctccaagctgtgccttggg

SEQ ID NO: 215 - RNA, 20 nt, Synthetic construct
  misc_feature 1..20: note = RNA protospacer sequence
  source 1..20: mol_type = other RNA
gtaaagagaggtgcgccccg

SEQ ID NO: 216 - RNA, 20 nt, Synthetic construct
  misc_feature 1..20: note = RNA protospacer sequence
  source 1..20: mol_type = other RNA
ggcagatgagaaggcacaga

SEQ ID NO: 217 - RNA, 20 nt, Synthetic construct
  misc_feature 1..20: note = RNA protospacer sequence
  source 1..20: mol_type = other RNA
aggagttccgcagtatggat

SEQ ID NO: 218 - RNA, 20 nt, Synthetic construct
  misc_feature 1..20: note = RNA protospacer sequence
  source 1..20: mol_type = other RNA
gctgtgccttgggtggcttt

SEQ ID NO: 219 - RNA, 20 nt, Synthetic construct
  misc_feature 1..20: note = RNA protospacer sequence
  source 1..20: mol_type = other RNA
acccctgctcgtgttacagg

SEQ ID NO: 220 - RNA, 20 nt, Synthetic construct
  misc_feature 1..20: note = RNA protospacer sequence
  source 1..20: mol_type = other RNA
cggaagtgttgataagatag

SEQ ID NO: 221 - RNA, 20 nt, Synthetic construct
  misc_feature 1..20: note = RNA protospacer sequence
  source 1..20: mol_type = other RNA
cctgctggtggctccagttc

SEQ ID NO: 222 - RNA, 20 nt, Synthetic construct
  misc_feature 1..20: note = RNA protospacer sequence
  source 1..20: mol_type = other RNA
cgagggagttcttcttctag

SEQ ID NO: 223 - RNA, 20 nt, Synthetic construct
  misc_feature 1..20: note = RNA protospacer sequence
  source 1..20: mol_type = other RNA
ggggcgcacctctctttacg

SEQ ID NO: 224 - RNA, 20 nt, Synthetic construct
  misc_feature 1..20: note = RNA protospacer sequence
  source 1..20: mol_type = other RNA
agcttggaggcttgaacagt

SEQ ID NO: 225 - RNA, 20 nt, Synthetic construct
  misc_feature 1..20: note = RNA protospacer sequence
  source 1..20: mol_type = other RNA
aagcctccaagctgtgcctt

SEQ ID NO: 226 - RNA, 20 nt, Synthetic construct
  misc_feature 1..20: note = RNA protospacer sequence
  source 1..20: mol_type = other RNA
cccctgctcgtgttacaggc

SEQ ID NO: 227 - RNA, 20 nt, Synthetic construct
  misc_feature 1..20: note = RNA protospacer sequence
  source 1..20: mol_type = other RNA
gcgagggagttcttcttcta

SEQ ID NO: 228 - RNA, 20 nt, Synthetic construct
  misc_feature 1..20: note = RNA protospacer sequence
  source 1..20: mol_type = other RNA
tactagtgccatttgttcag

SEQ ID NO: 229 - RNA, 20 nt, Synthetic construct
  misc_feature 1..20: note = RNA protospacer sequence
  source 1..20: mol_type = other RNA
gacttctctcaattttctag

SEQ ID NO: 230 - RNA, 20 nt, Synthetic construct
  misc_feature 1..20: note = RNA protospacer sequence
  source 1..20: mol_type = other RNA
attgacccgtataaagaatt

SEQ ID NO: 231 - RNA, 20 nt, Synthetic construct
  misc_feature 1..20: note = RNA protospacer sequence
  source 1..20: mol_type = other RNA
acccaaagacaaaagaaaat

SEQ ID NO: 232 - RNA, 20 nt, Synthetic construct
  misc_feature 1..20: note = RNA protospacer sequence
  source 1..20: mol_type = other RNA
gtcctcttatgtaagacctt

SEQ ID NO: 233 - RNA, 20 nt, Synthetic construct
  misc_feature 1..20: note = RNA protospacer sequence
  source 1..20: mol_type = other RNA
tgatcgggaaagaatcccag

SEQ ID NO: 234 - RNA, 20 nt, Synthetic construct
  misc_feature 1..20: note = RNA protospacer sequence
  source 1..20: mol_type = other RNA
tttgctgacgcaacccccac

SEQ ID NO: 235 - RNA, 20 nt, Synthetic construct
  misc_feature 1..20: note = RNA protospacer sequence
  source 1..20: mol_type = other RNA
atgaatctagccacctgggt

SEQ ID NO: 236 - RNA, 20 nt, Synthetic construct
  misc_feature 1..20: note = RNA protospacer sequence
  source 1..20: mol_type = other RNA
ggtctccatgcgacgtgcag

SEQ ID NO: 237 - RNA, 20 nt, Synthetic construct
  misc_feature 1..20: note = RNA protospacer sequence
  source 1..20: mol_type = other RNA
ggactgaggcccactcccat

SEQ ID NO: 238 - RNA, 20 nt, Synthetic construct
  misc_feature 1..20: note = RNA protospacer sequence
  source 1..20: mol_type = other RNA
cacagagtctagactcgtgg

SEQ ID NO: 239 - RNA, 20 nt, Synthetic construct
  misc_feature 1..20: note = RNA protospacer sequence
  source 1..20: mol_type = other RNA
gaagaaccaacaagaagatg

SEQ ID NO: 240 - RNA, 20 nt, Synthetic construct
  misc_feature 1..20: note = RNA protospacer sequence
  source 1..20: mol_type = other RNA
acacggtccggcagatgaga

SEQ ID NO: 241 - RNA, 20 nt, Synthetic construct
  misc_feature 1..20: note = RNA protospacer sequence
  source 1..20: mol_type = other RNA
gacatgaacatgagatgatt

SEQ ID NO: 242 - RNA, 20 nt, Synthetic construct
  misc_feature 1..20: note = RNA protospacer sequence
  source 1..20: mol_type = other RNA
gcagcacagcctagcagcca

SEQ ID NO: 243 - RNA, 20 nt, Synthetic construct
  misc_feature 1..20: note = RNA protospacer sequence
  source 1..20: mol_type = other RNA
tcctggaattagaggacaaa

SEQ ID NO: 244 - RNA, 20 nt, Synthetic construct
  misc_feature 1..20: note = RNA protospacer sequence
  source 1..20: mol_type = other RNA
gtcttacataagaggactct

SEQ ID NO: 245 - RNA, 20 nt, Synthetic construct
  misc_feature 1..20: note = RNA protospacer sequence
  source 1..20: mol_type = other RNA
ttgtgggtcaccatattctt

SEQ ID NO: 246 - RNA, 20 nt, Synthetic construct
  misc_feature 1..20: note = RNA protospacer sequence
  source 1..20: mol_type = other RNA
cgcaaaatacctatgggagt

SEQ ID NO: 247 - RNA, 20 nt, Synthetic construct
  misc_feature 1..20: note = RNA protospacer sequence
  source 1..20: mol_type = other RNA
gggttgcgtcagcaaacact

SEQ ID NO: 248 - RNA, 20 nt, Synthetic construct
  misc_feature 1..20: note = RNA protospacer sequence
  source 1..20: mol_type = other RNA
agctcttgttcccaagaata

SEQ ID NO: 249 - RNA, 20 nt, Synthetic construct
  misc_feature 1..20: note = RNA protospacer sequence
  source 1..20: mol_type = other RNA
tgacatactttccaatcaat

SEQ ID NO: 250 - RNA, 20 nt, Synthetic construct
  misc_feature 1..20: note = RNA protospacer sequence
  source 1..20: mol_type = other RNA
cagatgagaaggcacagacg

SEQ ID NO: 251 - RNA, 20 nt, Synthetic construct
  misc_feature 1..20: note = RNA protospacer sequence
  source 1..20: mol_type = other RNA
ccccgcctgtaacacgagca

SEQ ID NO: 252 - RNA, 20 nt, Synthetic construct
  misc_feature 1..20: note = RNA protospacer sequence
  source 1..20: mol_type = other RNA
gggtggagccctcaggctca

SEQ ID NO: 253 - RNA, 20 nt, Synthetic construct
  misc_feature 1..20: note = RNA protospacer sequence
  source 1..20: mol_type = other RNA
attccttggactcataaggt

SEQ ID NO: 254 - RNA, 20 nt, Synthetic construct
  misc_feature 1..20: note = RNA protospacer sequence
  source 1..20: mol_type = other RNA
tttgtgggtcaccatattct

SEQ ID NO: 255 - RNA, 20 nt, Synthetic construct
  misc_feature 1..20: note = RNA protospacer sequence
  source 1..20: mol_type = other RNA
gtgaaaaagttgcatggtgc

SEQ ID NO: 256 - RNA, 20 nt, Synthetic construct
  misc_feature 1..20: note = RNA protospacer sequence
  source 1..20: mol_type = other RNA
cctgaactggagccaccagc

SEQ ID NO: 257 - RNA, 20 nt, Synthetic construct
  misc_feature 1..20: note = RNA protospacer sequence
  source 1..20: mol_type = other RNA
tcctctgccgatccatactg

SEQ ID NO: 258 - RNA, 20 nt, Synthetic construct
  misc_feature 1..20: note = RNA protospacer sequence
  source 1..20: mol_type = other RNA
cggctaggagttccgcagta

SEQ ID NO: 259 - RNA, 20 nt, Synthetic construct
  misc_feature 1..20: note = RNA protospacer sequence
  source 1..20: mol_type = other RNA
aatgtcaacgaccgaccttg

SEQ ID NO: 260 - RNA, 20 nt, Synthetic construct
  misc_feature 1..20: note = RNA protospacer sequence
  source 1..20: mol_type = other RNA
gaccttcgtctgcgaggcga

SEQ ID NO: 261 - RNA, 20 nt, Synthetic construct
  misc_feature 1..20: note = RNA protospacer sequence
  source 1..20: mol_type = other RNA
gttgccgggcaacggggtaa

SEQ ID NO: 262 - RNA, 20 nt, Synthetic construct
  misc_feature 1..20: note = RNA protospacer sequence
  source 1..20: mol_type = other RNA
gattgagaccttcgtctgcg

SEQ ID NO: 263 - RNA, 20 nt, Synthetic construct
  misc_feature 1..20: note = RNA protospacer sequence
  source 1..20: mol_type = other RNA
aggacccctgctcgtgttac

SEQ ID NO: 264 - RNA, 20 nt, Synthetic construct
  misc_feature 1..20: note = RNA protospacer sequence
  source 1..20: mol_type = other RNA
tttgaagtatgcctcaaggt

SEQ ID NO: 265 - RNA, 20 nt, Synthetic construct
  misc_feature 1..20: note = RNA protospacer sequence
  source 1..20: mol_type = other RNA
ccgcttgttttgctcgcagc

SEQ ID NO: 266 - RNA, 20 nt, Synthetic construct
  misc_feature 1..20: note = RNA protospacer sequence
  source 1..20: mol_type = other RNA
tgctaggctgtgctgccaac

SEQ ID NO: 267 - RNA, 20 nt, Synthetic construct
  misc_feature 1..20: note = RNA protospacer sequence
  source 1..20: mol_type = other RNA
tgccgattggtggaggcagg

SEQ ID NO: 268 - RNA, 20 nt, Synthetic construct
  misc_feature 1..20: note = RNA protospacer sequence
  source 1..20: mol_type = other RNA
tctttgtactaggaggctgt

SEQ ID NO: 269 - RNA, 20 nt, Synthetic construct
  misc_feature 1..20: note = RNA protospacer sequence
  source 1..20: mol_type = other RNA
cgtcccgcgcaggatccagt

SEQ ID NO: 270 - RNA, 20 nt, Synthetic construct
  misc_feature 1..20: note = RNA protospacer sequence
  source 1..20: mol_type = other RNA
aaagcccaagatgatgggat

SEQ ID NO: 271 - RNA, 20 nt, Synthetic construct
  misc_feature 1..20: note = RNA protospacer sequence
  source 1..20: mol_type = other RNA
gcagatgagaaggcacagac

SEQ ID NO: 272 - RNA, 20 nt, Synthetic construct
  misc_feature 1..20: note = RNA protospacer sequence
  source 1..20: mol_type = other RNA
cgattggtggaggcaggagg

SEQ ID NO: 273 - RNA, 20 nt, Synthetic construct
  misc_feature 1..20: note = RNA protospacer sequence
  source 1..20: mol_type = other RNA
aggaggctgtaggcataaat

SEQ ID NO: 274 - RNA, 20 nt, Synthetic construct
  misc_feature 1..20: note = RNA protospacer sequence
  source 1..20: mol_type = other RNA
ccatgccccaaagccaccca

SEQ ID NO: 275 - RNA, 20 nt, Synthetic construct
  misc_feature 1..20: note = RNA protospacer sequence
  source 1..20: mol_type = other RNA
aggttggggactgcgaattt

SEQ ID NO: 276 - RNA, 20 nt, Synthetic construct
  misc_feature 1..20: note = RNA protospacer sequence
  source 1..20: mol_type = other RNA
agaccttcgtctgcgaggcg

SEQ ID NO: 277 - RNA, 20 nt, Synthetic construct
  misc_feature 1..20: note = RNA protospacer sequence
  source 1..20: mol_type = other RNA
cctggaattagaggacaaac

SEQ ID NO: 278 - RNA, 20 nt, Synthetic construct
  misc_feature 1..20: note = RNA protospacer sequence
  source 1..20: mol_type = other RNA
tttcagttatatggatgatg

SEQ ID NO: 279 - RNA, 20 nt, Synthetic construct
  misc_feature 1..20: note = RNA protospacer sequence
  source 1..20: mol_type = other RNA
gtaacacgagcaggggtcct

SEQ ID NO: 280 - RNA, 20 nt, Synthetic construct
  misc_feature 1..20: note = RNA protospacer sequence
  source 1..20: mol_type = other RNA
catcttcttgttggttcttc

SEQ ID NO: 281 - RNA, 20 nt, Synthetic construct
  misc_feature 1..20: note = RNA protospacer sequence
  source 1..20: mol_type = other RNA
cggggagaccgcgtaaagag

SEQ ID NO: 282 - RNA, 20 nt, Synthetic construct
  misc_feature 1..20: note = RNA protospacer sequence
  source 1..20: mol_type = other RNA
ctagactctgtggtattgtg

SEQ ID NO: 283 - RNA, 20 nt, Synthetic construct
  misc_feature 1..20: note = RNA protospacer sequence
  source 1..20: mol_type = other RNA
ccctgctcgtgttacaggcg

SEQ ID NO: 284 - RNA, 20 nt, Synthetic construct
  misc_feature 1..20: note = RNA protospacer sequence
  source 1..20: mol_type = other RNA
taccacagagtctagactcg

SEQ ID NO: 285 - RNA, 20 nt, Synthetic construct
  misc_feature 1..20: note = RNA protospacer sequence
  source 1..20: mol_type = other RNA
tcgcaaaatacctatgggag

SEQ ID NO: 286 - RNA, 20 nt, Synthetic construct
  misc_feature 1..20: note = RNA protospacer sequence
  source 1..20: mol_type = other RNA
gtctgtgccttctcatctgc

SEQ ID NO: 287 - RNA, 20 nt, Synthetic construct
  misc_feature 1..20: note = RNA protospacer sequence
  source 1..20: mol_type = other RNA
acacgtagcgcctcattttg

SEQ ID NO: 288 - RNA, 20 nt, Synthetic construct
  misc_feature 1..20: note = RNA protospacer sequence
  source 1..20: mol_type = other RNA
ttggggttgaggtcccaatc

SEQ ID NO: 289 - RNA, 20 nt, Synthetic construct
  misc_feature 1..20: note = RNA protospacer sequence
  source 1..20: mol_type = other RNA
ccccgagacgggtcgtccgc

SEQ ID NO: 290 - RNA, 20 nt, Synthetic construct
  misc_feature 1..20: note = RNA protospacer sequence
  source 1..20: mol_type = other RNA
cctacgaaccactgaacaaa

SEQ ID NO: 291 - RNA, 20 nt, Synthetic construct
  misc_feature 1..20: note = RNA protospacer sequence
  source 1..20: mol_type = other RNA
ttacatactctgtggaaggc

SEQ ID NO: 292 - RNA, 20 nt, Synthetic construct
  misc_feature 1..20: note = RNA protospacer sequence
  source 1..20: mol_type = other RNA
acctcctttccatggctgct

SEQ ID NO: 293 - RNA, 20 nt, Synthetic construct
  misc_feature 1..20: note = RNA protospacer sequence
  source 1..20: mol_type = other RNA
gttatcgctggatgtgtctg

SEQ ID NO: 294 - RNA, 20 nt, Synthetic construct
  misc_feature 1..20: note = RNA protospacer sequence
  source 1..20: mol_type = other RNA
aacatgagatgattaggcag

SEQ ID NO: 295 - RNA, 20 nt, Synthetic construct
  misc_feature 1..20: note = RNA protospacer sequence
  source 1..20: mol_type = other RNA
acttctctcaattttctagg

SEQ ID NO: 296 - RNA, 20 nt, Synthetic construct
  misc_feature 1..20: note = RNA protospacer sequence
  source 1..20: mol_type = other RNA
cactttctcgccaacttaca

SEQ ID NO: 297 - RNA, 20 nt, Synthetic construct
  misc_feature 1..20: note = RNA protospacer sequence
  source 1..20: mol_type = other RNA
cataaggtgggaaactttac

SEQ ID NO: 298 - RNA, 20 nt, Synthetic construct
  misc_feature 1..20: note = RNA protospacer sequence
  source 1..20: mol_type = other RNA
ccaaacctcgaaaaggcatg

SEQ ID NO: 299 - RNA, 20 nt, Synthetic construct
  misc_feature 1..20: note = RNA protospacer sequence
  source 1..20: mol_type = other RNA
atagaaggaaagaagtcaga

SEQ ID NO: 300 - RNA, 20 nt, Synthetic construct
  misc_feature 1..20: note = RNA protospacer sequence
  source 1..20: mol_type = other RNA
gctgctccttttacacaatg

SEQ ID NO: 301 - RNA, 20 nt, Synthetic construct
  misc_feature 1..20: note = RNA protospacer sequence
  source 1..20: mol_type = other RNA
gaagcgaagtgcacacggtc

SEQ ID NO: 302 - RNA, 20 nt, Synthetic construct
  misc_feature 1..20: note = RNA protospacer sequence
  source 1..20: mol_type = other RNA
ggatcatcaaccaccagcac

SEQ ID NO: 303 - RNA, 20 nt, Synthetic construct
  misc_feature 1..20: note = RNA protospacer sequence
  source 1..20: mol_type = other RNA
gagccaagagaaacggactg

SEQ ID NO: 304 - RNA, 20 nt, Synthetic construct
  misc_feature 1..20: note = RNA protospacer sequence
  source 1..20: mol_type = other RNA
cttcacctctgcacgtcgca

SEQ ID NO: 305 - RNA, 20 nt, Synthetic construct
  misc_feature 1..20: note = RNA protospacer sequence
  source 1..20: mol_type = other RNA
acaatgttccggagactcta

SEQ ID NO: 306 - RNA, 20 nt, Synthetic construct
  misc_feature 1..20: note = RNA protospacer sequence
  source 1..20: mol_type = other RNA
tccgcgggattcagcgccga

SEQ ID NO: 307 - RNA, 20 nt, Synthetic construct
  misc_feature 1..20: note = RNA protospacer sequence
  source 1..20: mol_type = other RNA
ttaatgagtgggaggagttg

SEQ ID NO: 308 - RNA, 20 nt, Synthetic construct
  misc_feature 1..20: note = RNA protospacer sequence
  source 1..20: mol_type = other RNA
ccaactcaaacaatccagat

SEQ ID NO: 309 - RNA, 20 nt, Synthetic construct
  misc_feature 1..20: note = RNA protospacer sequence
  source 1..20: mol_type = other RNA
gctgccaactggatcctgcg

SEQ ID NO: 310 - RNA, 20 nt, Synthetic construct
  misc_feature 1..20: note = RNA protospacer sequence
  source 1..20: mol_type = other RNA
agtctttgaagtatgcctca

SEQ ID NO: 311 - RNA, 20 nt, Synthetic construct
  misc_feature 1..20: note = RNA protospacer sequence
  source 1..20: mol_type = other RNA
tcctgactgccgattggtgg

SEQ ID NO: 312 - RNA, 20 nt, Synthetic construct
  misc_feature 1..20: note = RNA protospacer sequence
  source 1..20: mol_type = other RNA
tcttgtcctccaatttgtcc

SEQ ID NO: 313 - RNA, 20 nt, Synthetic construct
  misc_feature 1..20: note = RNA protospacer sequence
  source 1..20: mol_type = other RNA
cgataaccaggacaaattgg

SEQ ID NO: 314 - RNA, 20 nt, Synthetic construct
  misc_feature 1..20: note = RNA protospacer sequence
  source 1..20: mol_type = other RNA
atttggaagatccagcatcc

SEQ ID NO: 315 - RNA, 20 nt, Synthetic construct
  misc_feature 1..20: note = RNA protospacer sequence
  source 1..20: mol_type = other RNA
ctgtttggctttcagttata

SEQ ID NO: 316 - RNA, 20 nt, Synthetic construct
  misc_feature 1..20: note = RNA protospacer sequence
  source 1..20: mol_type = other RNA
ctcctcctgcctccaccaat

SEQ ID NO: 317 - RNA, 20 nt, Synthetic construct
  misc_feature 1..20: note = RNA protospacer sequence
  source 1..20: mol_type = other RNA
gtcatcctcaggccatgcag

SEQ ID NO: 318 - RNA, 20 nt, Synthetic construct
  misc_feature 1..20: note = RNA protospacer sequence
  source 1..20: mol_type = other RNA
ctgccgttccggccgaccac

SEQ ID NO: 319 - RNA, 20 nt, Synthetic construct
  misc_feature 1..20: note = RNA protospacer sequence
  source 1..20: mol_type = other RNA
ccttcctgactgccgattgg

SEQ ID NO: 320 - RNA, 20 nt, Synthetic construct
  misc_feature 1..20: note = RNA protospacer sequence
  source 1..20: mol_type = other RNA
acctgcacgactcctgctca

SEQ ID NO: 321 - RNA, 20 nt, Synthetic construct
  misc_feature 1..20: note = RNA protospacer sequence
  source 1..20: mol_type = other RNA
ggcctgtattttcctgctgg

SEQ ID NO: 322 - RNA, 20 nt, Synthetic construct
  misc_feature 1..20: note = RNA protospacer sequence
  source 1..20: mol_type = other RNA
aacatagaggttccttgagc

SEQ ID NO: 323 - RNA, 20 nt, Synthetic construct
  misc_feature 1..20: note = RNA protospacer sequence
  source 1..20: mol_type = other RNA
tgccgttccggccgaccacg

SEQ ID NO: 324 - RNA, 20 nt, Synthetic construct
  misc_feature 1..20: note = RNA protospacer sequence
  source 1..20: mol_type = other RNA
ataggccatcagcgcatgcg

SEQ ID NO: 325 - RNA, 20 nt, Synthetic construct
  misc_feature 1..20: note = RNA protospacer sequence
  source 1..20: mol_type = other RNA
gcctccaccaatcggcagtc

SEQ ID NO: 326 - RNA, 20 nt, Synthetic construct
  misc_feature 1..20: note = RNA protospacer sequence
  source 1..20: mol_type = other RNA
gtcctttgtttacgtcccgt

SEQ ID NO: 327 - RNA, 20 nt, Synthetic construct
  misc_feature 1..20: note = RNA protospacer sequence
  source 1..20: mol_type = other RNA
tgggaacaagagctacagca

SEQ ID NO: 328 - RNA, 20 nt, Synthetic construct
  misc_feature 1..20: note = RNA protospacer sequence
  source 1..20: mol_type = other RNA
ctgtaaacaggcctattgat

SEQ ID NO: 329 - RNA, 20 nt, Synthetic construct
  misc_feature 1..20: note = RNA protospacer sequence
  source 1..20: mol_type = other RNA
gtcgcagaagatctcaatct

SEQ ID NO: 330 - RNA, 20 nt, Synthetic construct
  misc_feature 1..20: note = RNA protospacer sequence
  source 1..20: mol_type = other RNA
ctgccttcctgactgccgat

SEQ ID NO: 331 - RNA, 20 nt, Synthetic construct
  misc_feature 1..20: note = RNA protospacer sequence
  source 1..20: mol_type = other RNA
actactaattccctggatgc

SEQ ID NO: 332 - RNA, 20 nt, Synthetic construct
  misc_feature 1..20: note = RNA protospacer sequence
  source 1..20: mol_type = other RNA
cacatttcttgccttacttt

SEQ ID NO: 333 - RNA, 20 nt, Synthetic construct
  misc_feature 1..20: note = RNA protospacer sequence
  source 1..20: mol_type = other RNA
ggatgactgtctcttagagg

SEQ ID NO: 334 - RNA, 20 nt, Synthetic construct
  misc_feature 1..20: note = RNA protospacer sequence
  source 1..20: mol_type = other RNA
gctatgcctcatcttcttgt

SEQ ID NO: 335 - RNA, 20 nt, Synthetic construct
  misc_feature 1..20: note = RNA protospacer sequence
  source 1..20: mol_type = other RNA
cccgtcggcgctgaatcccg

SEQ ID NO: 336 - RNA, 20 nt, Synthetic construct
  misc_feature 1..20: note = RNA protospacer sequence
  source 1..20: mol_type = other RNA
tagtattccttggactcata

SEQ ID NO: 337 - RNA, 20 nt, Synthetic construct
  misc_feature 1..20: note = RNA protospacer sequence
  source 1..20: mol_type = other RNA
aggtaggagcgggagcattc

SEQ ID NO: 338 - RNA, 20 nt, Synthetic construct
  misc_feature 1..20: note = RNA protospacer sequence
  source 1..20: mol_type = other RNA
tcttttggggtggagccctc

SEQ ID NO: 339 - RNA, 20 nt, Synthetic construct
  misc_feature 1..20: note = RNA protospacer sequence
  source 1..20: mol_type = other RNA
tcagtatgccctgagcctga

SEQ ID NO: 340 - RNA, 20 nt, Synthetic construct
  misc_feature 1..20: note = RNA protospacer sequence
  source 1..20: mol_type = other RNA
tttaatgagtgggaggagtt

SEQ ID NO: 341 - RNA, 20 nt, Synthetic construct
  misc_feature 1..20: note = RNA protospacer sequence
  source 1..20: mol_type = other RNA
ctccctcgcctcgcagacga

SEQ ID NO: 342 - RNA, 20 nt, Synthetic construct
  misc_feature 1..20: note = RNA protospacer sequence
  source 1..20: mol_type = other RNA
gataagataggggcatttgg

SEQ ID NO: 343 - RNA, 20 nt, Synthetic construct
  misc_feature 1..20: note = RNA protospacer sequence
  source 1..20: mol_type = other RNA
ccgcgggattcagcgccgac

SEQ ID NO: 344 - RNA, 20 nt, Synthetic construct
  misc_feature 1..20: note = RNA protospacer sequence
  source 1..20: mol_type = other RNA
cagcgataaccaggacaaat

SEQ ID NO: 345 - RNA, 20 nt, Synthetic construct
  misc_feature 1..20: note = RNA protospacer sequence
  source 1..20: mol_type = other RNA
caggtaggagtgggagcatt

SEQ ID NO: 346 - RNA, 20 nt, Synthetic construct
  misc_feature 1..20: note = RNA protospacer sequence
  source 1..20: mol_type = other RNA
gtttaatgagtgggaggagt

SEQ ID NO: 347 - RNA, 20 nt, Synthetic construct
  misc_feature 1..20: note = RNA protospacer sequence
  source 1..20: mol_type = other RNA
tggtgagtgattggaggttg

SEQ ID NO: 348 - RNA, 20 nt, Synthetic construct
  misc_feature 1..20: note = RNA protospacer sequence
  source 1..20: mol_type = other RNA
taatgagtgggaggagttgg

SEQ ID NO: 349 - RNA, 20 nt, Synthetic construct
  misc_feature 1..20: note = RNA protospacer sequence
  source 1..20: mol_type = other RNA
actacatgttctggataata

SEQ ID NO: 350 - RNA, 20 nt, Synthetic construct
  misc_feature 1..20: note = RNA protospacer sequence
  source 1..20: mol_type = other RNA
ggcatagcagcaggatgaag

SEQ ID NO: 351 - RNA, 20 nt, Synthetic construct
  misc_feature 1..20: note = RNA protospacer sequence
  source 1..20: mol_type = other RNA
gttgataagataggggcatt

SEQ ID NO: 352 - RNA, 20 nt, Synthetic construct
  misc_feature 1..20: note = RNA protospacer sequence
  source 1..20: mol_type = other RNA
tcaacgaattgtgggtcttt

SEQ ID NO: 353 - RNA, 20 nt, Synthetic construct
  misc_feature 1..20: note = RNA protospacer sequence
  source 1..20: mol_type = other RNA
tatggatgatgtggtattgg

SEQ ID NO: 354 - RNA, 20 nt, Synthetic construct
  misc_feature 1..20: note = RNA protospacer sequence
  source 1..20: mol_type = other RNA
caacgaattgtgggtctttt

SEQ ID NO: 355 - RNA, 20 nt, Synthetic construct
  misc_feature 1..20: note = RNA protospacer sequence
  source 1..20: mol_type = other RNA
catttgttcagtggttcgta

SEQ ID NO: 356 - RNA, 20 nt, Synthetic construct
  misc_feature 1..20: note = RNA protospacer sequence
  source 1..20: mol_type = other RNA
cgtctaacaacagtagtttc

SEQ ID NO: 357 - RNA, 20 nt, Synthetic construct
  misc_feature 1..20: note = RNA protospacer sequence
  source 1..20: mol_type = other RNA
tgcctgagtgctgtatggtg

SEQ ID NO: 358 - RNA, 20 nt, Synthetic construct
  misc_feature 1..20: note = RNA protospacer sequence
  source 1..20: mol_type = other RNA
gccccgagacgggtcgtccg

SEQ ID NO: 359 - RNA, 20 nt, Synthetic construct
  misc_feature 1..20: note = RNA protospacer sequence
  source 1..20: mol_type = other RNA
gactgccgattggtggaggc

SEQ ID NO: 360 - RNA, 20 nt, Synthetic construct
  misc_feature 1..20: note = RNA protospacer sequence
  source 1..20: mol_type = other RNA
tatatggatgatgtggtatt

SEQ ID NO: 361 - RNA, 20 nt, Synthetic construct
  misc_feature 1..20: note = RNA protospacer sequence
  source 1..20: mol_type = other RNA
cttgagtatttggtgtcttt

SEQ ID NO: 362 - RNA, 20 nt, Synthetic construct
  misc_feature 1..20: note = RNA protospacer sequence
  source 1..20: mol_type = other RNA
gatctggtgggcgttcacgg

SEQ ID NO: 363 - RNA, 20 nt, Synthetic construct
  misc_feature 1..20: note = RNA protospacer sequence
  source 1..20: mol_type = other RNA
agactgggaggagttggggg

SEQ ID NO: 364 - RNA, 20 nt, Synthetic construct
  misc_feature 1..20: note = RNA protospacer sequence
  source 1..20: mol_type = other RNA
agtcctcttatgtaagacct

SEQ ID NO: 365 - RNA, 20 nt, Synthetic construct
  misc_feature 1..20: note = RNA protospacer sequence
  source 1..20: mol_type = other RNA
ctcaagatgttgtacagact

SEQ ID NO: 366 - RNA, 20 nt, Synthetic construct
  misc_feature 1..20: note = RNA protospacer sequence
  source 1..20: mol_type = other RNA
gggaacaagagctacagcat

SEQ ID NO: 367 - RNA, 20 nt, Synthetic construct
  misc_feature 1..20: note = RNA protospacer sequence
  source 1..20: mol_type = other RNA
tcgcagaagatctcaatctc

SEQ ID NO: 368 - RNA, 20 nt, Synthetic construct
  misc_feature 1..20: note = RNA protospacer sequence
  source 1..20: mol_type = other RNA
ggggtggagccctcaggctc

SEQ ID NO: 369 - RNA, 20 nt, Synthetic construct
  misc_feature 1..20: note = RNA protospacer sequence
  source 1..20: mol_type = other RNA
tattccttggactcataagg

SEQ ID NO: 370 - RNA, 20 nt, Synthetic construct
  misc_feature 1..20: note = RNA protospacer sequence
  source 1..20: mol_type = other RNA
tctaagagacagtcatcctc

SEQ ID NO: 371 - RNA, 20 nt, Synthetic construct
  misc_feature 1..20: note = RNA protospacer sequence
  source 1..20: mol_type = other RNA
caactcaaacaatccagatt

SEQ ID NO: 372 - RNA, 20 nt, Synthetic construct
  misc_feature 1..20: note = RNA protospacer sequence
  source 1..20: mol_type = other RNA
aaacaaaggacgtcccgcgc

SEQ ID NO: 373 - RNA, 20 nt, Synthetic construct
  misc_feature 1..20: note = RNA protospacer sequence
  source 1..20: mol_type = other RNA
ctgccaactggatcctgcgc

SEQ ID NO: 374 - RNA, 20 nt, Synthetic construct
  misc_feature 1..20: note = RNA protospacer sequence
  source 1..20: mol_type = other RNA
gaagctccaaattctttata

SEQ ID NO: 375 - RNA, 20 nt, Synthetic construct
  misc_feature 1..20: note = RNA protospacer sequence
  source 1..20: mol_type = other RNA
gtcagtatgccctgagcctg

SEQ ID NO: 376 - RNA, 20 nt, Synthetic construct
  misc_feature 1..20: note = RNA protospacer sequence
  source 1..20: mol_type = other RNA
tttcccaccttatgagtcca

SEQ ID NO: 377 - RNA, 20 nt, Synthetic construct
  misc_feature 1..20: note = RNA protospacer sequence
  source 1..20: mol_type = other RNA
acaagaggttggtgagtgat

SEQ ID NO: 378 - RNA, 20 nt, Synthetic construct
  misc_feature 1..20: note = RNA protospacer sequence
  source 1..20: mol_type = other RNA
gaaagcccaagatgatggga

SEQ ID NO: 379 - RNA, 20 nt, Synthetic construct
  misc_feature 1..20: note = RNA protospacer sequence
  source 1..20: mol_type = other RNA
aggttccacgcatgcgctga

SEQ ID NO: 380 - RNA, 20 nt, Synthetic construct
  misc_feature 1..20: note = RNA protospacer sequence
  source 1..20: mol_type = other RNA
ttggtgagtgattggaggtt

SEQ ID NO: 381 - RNA, 20 nt, Synthetic construct
  misc_feature 1..20: note = RNA protospacer sequence
  source 1..20: mol_type = other RNA
agagctacagcatgggaggt

SEQ ID NO: 382 - RNA, 20 nt, Synthetic construct
  misc_feature 1..20: note = RNA protospacer sequence
  source 1..20: mol_type = other RNA
atatggatgatgtggtattg

SEQ ID NO: 383 - RNA, 20 nt, Synthetic construct
  misc_feature 1..20: note = RNA protospacer sequence
  source 1..20: mol_type = other RNA
ccatttgttcagtggttcgt

SEQ ID NO: 384 - RNA, 20 nt, Synthetic construct
  misc_feature 1..20: note = RNA protospacer sequence
  source 1..20: mol_type = other RNA
ttatatggatgatgtggtat

SEQ ID NO: 385 - RNA, 20 nt, Synthetic construct
  misc_feature 1..20: note = RNA protospacer sequence
  source 1..20: mol_type = other RNA
ggagtgggagcattcgggcc

SEQ ID NO: 386 - RNA, 20 nt, Synthetic construct
  misc_feature 1..20: note = RNA protospacer sequence
  source 1..20: mol_type = other RNA
atttggtgtcttttggagtg

SEQ ID NO: 387 - RNA, 20 nt, Synthetic construct
  misc_feature 1..20: note = RNA protospacer sequence
  source 1..20: mol_type = other RNA
cacagaaaggccttgtaagt

SEQ ID NO: 388 - RNA, 20 nt, Synthetic construct
  misc_feature 1..20: note = RNA protospacer sequence
  source 1..20: mol_type = other RNA
accaattttcttttgtcttt

SEQ ID NO: 389 - RNA, 20 nt, Synthetic construct
  misc_feature 1..20: note = RNA protospacer sequence
  source 1..20: mol_type = other RNA
aggttaatggtctttgtact

SEQ ID NO: 390 - RNA, 20 nt, Synthetic construct
  misc_feature 1..20: note = RNA protospacer sequence
  source 1..20: mol_type = other RNA
taccaattttcttttgtctt

SEQ ID NO: 391 - RNA, 106 nt, Synthetic construct
  misc_feature 1..106: note = gRNA (spacer + SpCas9)
  source 1..106: mol_type = other RNA
ccctatcttatcaacacttcgtttaagagctatgctggaaacagcatagcaagtttaaataaggctagtccgttatcaacttgaaaaagtggcaccgagtcggtgc

SEQ ID NO: 392 - RNA, 106 nt, Synthetic construct
  misc_feature 1..106: note = gRNA (spacer + SpCas9)
  source 1..106: mol_type = other RNA
gcagaggtgaaaaagttgcagtttaagagctatgctggaaacagcatagcaagtttaaataaggctagtccgttatcaacttgaaaaagtggcaccgagtcggtgc

SEQ ID NO: 393 - RNA, 106 nt, Synthetic construct
  misc_feature 1..106: note = gRNA (spacer + SpCas9)
  source 1..106: mol_type = other RNA
tggacttctctcaattttctgtttaagagctatgctggaaacagcatagcaagtttaaataaggctagtccgttatcaacttgaaaaagtggcaccgagtcggtgc

SEQ ID NO: 394 - RNA, 106 nt, Synthetic construct
  misc_feature 1..106: note = gRNA (spacer + SpCas9)
  source 1..106: mol_type = other RNA
accccgcctgtaacacgagcgtttaagagctatgctggaaacagcatagcaagtttaaataaggctagtccgttatcaacttgaaaaagtggcaccgagtcggtgc

SEQ ID NO: 395 - RNA, 106 nt, Synthetic construct
  misc_feature 1..106: note = gRNA (spacer + SpCas9)
  source 1..106: mol_type = other RNA
cccgcctgtaacacgagcaggtttaagagctatgctggaaacagcatagcaagtttaaataaggctagtccgttatcaacttgaaaaagtggcaccgagtcggtgc

SEQ ID NO: 396 - RNA, 106 nt, Synthetic construct
  misc_feature 1..106: note = gRNA (spacer + SpCas9)
  source 1..106: mol_type = other RNA
caccacgagtctagactctggtttaagagctatgctggaaacagcatagcaagtttaaataaggctagtccgttatcaacttgaaaaagtggcaccgagtcggtgc

SEQ ID NO: 397 - RNA, 106 nt, Synthetic construct
  misc_feature 1..106: note = gRNA (spacer + SpCas9)
  source 1..106: mol_type = other RNA
gaggtgaagcgaagtgcacagtttaagagctatgctggaaacagcatagcaagtttaaataaggctagtccgttatcaacttgaaaaagtggcaccgagtcggtgc

SEQ ID NO: 398 - RNA, 106 nt, Synthetic construct
  misc_feature 1..106: note = gRNA (spacer + SpCas9)
  source 1..106: mol_type = other RNA
ccggaagtgttgataagatagtttaagagctatgctggaaacagcatagcaagtttaaataaggctagtccgttatcaacttgaaaaagtggcaccgagtcggtgc

SEQ ID NO: 399 - RNA, 106 nt, Synthetic construct
  misc_feature 1..106: note = gRNA (spacer + SpCas9)
  source 1..106: mol_type = other RNA
agaagatgaggcatagcagcgtttaagagctatgctggaaacagcatagcaagtttaaataaggctagtccgttatcaacttgaaaaagtggcaccgagtcggtgc

SEQ ID NO: 400 - RNA, 106 nt, Synthetic construct
  misc_feature 1..106: note = gRNA (spacer + SpCas9)
  source 1..106: mol_type = other RNA
tccgcagtatggatcggcaggtttaagagctatgctggaaacagcatagcaagtttaaataaggctagtccgttatcaacttgaaaaagtggcaccgagtcggtgc

SEQ ID NO: 401 - RNA, 106 nt, Synthetic construct
  misc_feature 1..106: note = gRNA (spacer + SpCas9)
  source 1..106: mol_type = other RNA
ggacttctctcaattttctagtttaagagctatgctggaaacagcatagcaagtttaaataaggctagtccgttatcaacttgaaaaagtggcaccgagtcggtgc

SEQ ID NO: 402 - RNA, 106 nt, Synthetic construct
  misc_feature 1..106: note = gRNA (spacer + SpCas9)
  source 1..106: mol_type = other RNA
ccacccaaggcacagcttgggtttaagagctatgctggaaacagcatagcaagtttaaataaggctagtccgttatcaacttgaaaaagtggcaccgagtcggtgc

SEQ ID NO: 403 - RNA, 106 nt, Synthetic construct
  misc_feature 1..106: note = gRNA (spacer + SpCas9)
  source 1..106: mol_type = other RNA
agagaggtgcgccccgtggtgtttaagagctatgctggaaacagcatagcaagtttaaataaggctagtccgttatcaacttgaaaaagtggcaccgagtcggtgc

SEQ ID NO: 404 - RNA, 106 nt, Synthetic construct
  misc_feature 1..106: note = gRNA (spacer + SpCas9)
  source 1..106: mol_type = other RNA
gattgagatcttctgcgacggtttaagagctatgctggaaacagcatagcaagtttaaataaggctagtccgttatcaacttgaaaaagtggcaccgagtcggtgc

SEQ ID NO: 405 - RNA, 106 nt, Synthetic construct
  misc_feature 1..106: note = gRNA (spacer + SpCas9)
  source 1..106: mol_type = other RNA
caagcctccaagctgtgcctgtttaagagctatgctggaaacagcatagcaagtttaaataaggctagtccgttatcaacttgaaaaagtggcaccgagtcggtgc

SEQ ID NO: 406 - RNA, 106 nt, Synthetic construct
  misc_feature 1..106: note = gRNA (spacer + SpCas9)
  source 1..106: mol_type = other RNA
ggcgagggagttcttcttctgtttaagagctatgctggaaacagcatagcaagtttaaataaggctagtccgttatcaacttgaaaaagtggcaccgagtcggtgc

SEQ ID NO: 407 - RNA, 106 nt, Synthetic construct
  misc_feature 1..106: note = gRNA (spacer + SpCas9)
  source 1..106: mol_type = other RNA
tccggaagtgttgataagatgtttaagagctatgctggaaacagcatagcaagtttaaataaggctagtccgttatcaacttgaaaaagtggcaccgagtcggtgc

SEQ ID NO: 408 - RNA, 106 nt, Synthetic construct
  misc_feature 1..106: note = gRNA (spacer + SpCas9)
  source 1..106: mol_type = other RNA
aagccacccaaggcacagctgtttaagagctatgctggaaacagcatagcaagtttaaataaggctagtccgttatcaacttgaaaaagtggcaccgagtcggtgc

SEQ ID NO: 409 - RNA, 106 nt, Synthetic construct
  misc_feature 1..106: note = gRNA (spacer + SpCas9)
  source 1..106: mol_type = other RNA
cctccaagctgtgccttggggtttaagagctatgctggaaacagcatagcaagtttaaataaggctagtccgttatcaacttgaaaaagtggcaccgagtcggtgc

SEQ ID NO: 410 - RNA, 106 nt, Synthetic construct
  misc_feature 1..106: note = gRNA (spacer + SpCas9)
  source 1..106: mol_type = other RNA
gtaaagagaggtgcgccccggtttaagagctatgctggaaacagcatagcaagtttaaataaggctagtccgttatcaacttgaaaaagtggcaccgagtcggtgc

SEQ ID NO: 411 - RNA, 106 nt, Synthetic construct
  misc_feature 1..106: note = gRNA (spacer + SpCas9)
  source 1..106: mol_type = other RNA
ggcagatgagaaggcacagagtttaagagctatgctggaaacagcatagcaagtttaaataaggctagtccgttatcaacttgaaaaagtggcaccgagtcggtgc

SEQ ID NO: 412 - RNA, 106 nt, Synthetic construct
  misc_feature 1..106: note = gRNA (spacer + SpCas9)
  source 1..106: mol_type = other RNA
aggagttccgcagtatggatgtttaagagctatgctggaaacagcatagcaagtttaaataaggctagtccgttatcaacttgaaaaagtggcaccgagtcggtgc

SEQ ID NO: 413 - RNA, 106 nt, Synthetic construct
  misc_feature 1..106: note = gRNA (spacer + SpCas9)
  source 1..106: mol_type = other RNA
gctgtgccttgggtggctttgtttaagagctatgctggaaacagcatagcaagtttaaataaggctagtccgttatcaacttgaaaaagtggcaccgagtcggtgc

SEQ ID NO: 414 - RNA, 106 nt, Synthetic construct
  misc_feature 1..106: note = gRNA (spacer + SpCas9)
  source 1..106: mol_type = other RNA
acccctgctcgtgttacagggtttaagagctatgctggaaacagcatagcaagtttaaataaggctagtccgttatcaacttgaaaaagtggcaccgagtcggtgc

SEQ ID NO: 415 - RNA, 106 nt, Synthetic construct
  misc_feature 1..106: note = gRNA (spacer + SpCas9)
  source 1..106: mol_type = other RNA
cggaagtgttgataagataggtttaagagctatgctggaaacagcatagcaagtttaaataaggctagtccgttatcaacttgaaaaagtggcaccgagtcggtgc

SEQ ID NO: 416 - RNA, 106 nt, Synthetic construct
  misc_feature 1..106: note = gRNA (spacer + SpCas9)
  source 1..106: mol_type = other RNA
cctgctggtggctccagttcgtttaagagctatgctggaaacagcatagcaagtttaaataaggctagtccgttatcaacttgaaaaagtggcaccgagtcggtgc

SEQ ID NO: 417 - RNA, 106 nt, Synthetic construct
  misc_feature 1..106: note = gRNA (spacer + SpCas9)
  source 1..106: mol_type = other RNA
cgagggagttcttcttctaggtttaagagctatgctggaaacagcatagcaagtttaaataaggctagtccgttatcaacttgaaaaagtggcaccgagtcggtgc

SEQ ID NO: 418 - RNA, 106 nt, Synthetic construct
  misc_feature 1..106: note = gRNA (spacer + SpCas9)
  source 1..106: mol_type = other RNA
ggggcgcacctctctttacggtttaagagctatgctggaaacagcatagcaagtttaaataaggctagtccgttatcaacttgaaaaagtggcaccgagtcggtgc

SEQ ID NO: 419 - RNA, 106 nt, Synthetic construct
  misc_feature 1..106: note = gRNA (spacer + SpCas9)
  source 1..106: mol_type = other RNA
agcttggaggcttgaacagtgtttaagagctatgctggaaacagcatagcaagtttaaataaggctagtccgttatcaacttgaaaaagtggcaccgagtcggtgc

SEQ ID NO: 420 - RNA, 106 nt, Synthetic construct
  misc_feature 1..106: note = gRNA (spacer + SpCas9)
  source 1..106: mol_type = other RNA
aagcctccaagctgtgccttgtttaagagctatgctggaaacagcatagcaagtttaaataaggctagtccgttatcaacttgaaaaagtggcaccgagtcggtgc

SEQ ID NO: 421 - RNA, 106 nt, Synthetic construct
  misc_feature 1..106: note = gRNA (spacer + SpCas9)
  source 1..106: mol_type = other RNA
cccctgctcgtgttacaggcgtttaagagctatgctggaaacagcatagcaagtttaaataaggctagtccgttatcaacttgaaaaagtggcaccgagtcggtgc

SEQ ID NO: 422 - RNA, 106 nt, Synthetic construct
  misc_feature 1..106: note = gRNA (spacer + SpCas9)
  source 1..106: mol_type = other RNA
gcgagggagttcttcttctagtttaagagctatgctggaaacagcatagcaagtttaaataaggctagtccgttatcaacttgaaaaagtggcaccgagtcggtgc

SEQ ID NO: 423 - RNA, 106 nt, Synthetic construct
  misc_feature 1..106: note = gRNA (spacer + SpCas9)
  source 1..106: mol_type = other RNA
tactagtgccatttgttcaggtttaagagctatgctggaaacagcatagcaagtttaaataaggctagtccgttatcaacttgaaaaagtggcaccgagtcggtgc

SEQ ID NO: 424 - RNA, 106 nt, Synthetic construct
  misc_feature 1..106: note = gRNA (spacer + SpCas9)
  source 1..106: mol_type = other RNA
gacttctctcaattttctaggtttaagagctatgctggaaacagcatagcaagtttaaataaggctagtccgttatcaacttgaaaaagtggcaccgagtcggtgc

SEQ ID NO: 425 - RNA, 106 nt, Synthetic construct
  misc_feature 1..106: note = gRNA (spacer + SpCas9)
  source 1..106: mol_type = other RNA
attgacccgtataaagaattgtttaagagctatgctggaaacagcatagcaagtttaaataaggctagtccgttatcaacttgaaaaagtggcaccgagtcggtgc

SEQ ID NO: 426 - RNA, 106 nt, Synthetic construct
  misc_feature 1..106: note = gRNA (spacer + SpCas9)
  source 1..106: mol_type = other RNA
acccaaagacaaaagaaaatgtttaagagctatgctggaaacagcatagcaagtttaaataaggctagtccgttatcaacttgaaaaagtggcaccgagtcggtgc

SEQ ID NO: 427 - RNA, 106 nt, Synthetic construct
  misc_feature 1..106: note = gRNA (spacer + SpCas9)
  source 1..106: mol_type = other RNA
gtcctcttatgtaagaccttgtttaagagctatgctggaaacagcatagcaagtttaaataaggctagtccgttatcaacttgaaaaagtggcaccgagtcggtgc

SEQ ID NO: 428 - RNA, 106 nt, Synthetic construct
  misc_feature 1..106: note = gRNA (spacer + SpCas9)
  source 1..106: mol_type = other RNA
tgatcgggaaagaatcccaggtttaagagctatgctggaaacagcatagcaagtttaaataaggctagtccgttatcaacttgaaaaagtggcaccgagtcggtgc

SEQ ID NO: 429 - RNA, 106 nt, Synthetic construct
  misc_feature 1..106: note = gRNA (spacer + SpCas9)
  source 1..106: mol_type = other RNA
tttgctgacgcaacccccacgtttaagagctatgctggaaacagcatagcaagtttaaataaggctagtccgttatcaacttgaaaaagtggcaccgagtcggtgc

SEQ ID NO: 430 - RNA, 106 nt, Synthetic construct
  misc_feature 1..106: note = gRNA (spacer + SpCas9)
  source 1..106: mol_type = other RNA
atgaatctagccacctgggtgtttaagagctatgctggaaacagcatagcaagtttaaataaggctagtccgttatcaacttgaaaaagtggcaccgagtcggtgc

SEQ ID NO: 431 - RNA, 106 nt, Synthetic construct
  misc_feature 1..106: note = gRNA (spacer + SpCas9)
  source 1..106: mol_type = other RNA
ggtctccatgcgacgtgcaggtttaagagctatgctggaaacagcatagcaagtttaaataaggctagtccgttatcaacttgaaaaagtggcaccgagtcggtgc

SEQ ID NO: 432 - RNA, 106 nt, Synthetic construct
  misc_feature 1..106: note = gRNA (spacer + SpCas9)
  source 1..106: mol_type = other RNA
ggactgaggcccactcccatgtttaagagctatgctggaaacagcatagcaagtttaaataaggctagtccgttatcaacttgaaaaagtggcaccgagtcggtgc

SEQ ID NO: 433 - RNA, 106 nt, Synthetic construct
  misc_feature 1..106: note = gRNA (spacer + SpCas9)
  source 1..106: mol_type = other RNA
cacagagtctagactcgtgggtttaagagctatgctggaaacagcatagcaagtttaaataaggctagtccgttatcaacttgaaaaagtggcaccgagtcggtgc

SEQ ID NO: 434 - RNA, 106 nt, Synthetic construct
  misc_feature 1..106: note = gRNA (spacer + SpCas9)
  source 1..106: mol_type = other RNA
gaagaaccaacaagaagatggtttaagagctatgctggaaacagcatagcaagtttaaataaggctagtccgttatcaacttgaaaaagtggcaccgagtcggtgc

SEQ ID NO: 435 - RNA, 106 nt, Synthetic construct
  misc_feature 1..106: note = gRNA (spacer + SpCas9)
  source 1..106: mol_type = other RNA
acacggtccggcagatgagagtttaagagctatgctggaaacagcatagcaagtttaaataaggctagtccgttatcaacttgaaaaagtggcaccgagtcggtgc

SEQ ID NO: 436 - RNA, 106 nt, Synthetic construct
  misc_feature 1..106: note = gRNA (spacer + SpCas9)
  source 1..106: mol_type = other RNA
gacatgaacatgagatgattgtttaagagctatgctggaaacagcatagcaagtttaaataaggctagtccgttatcaacttgaaaaagtggcaccgagtcggtgc

SEQ ID NO: 437 - RNA, 106 nt, Synthetic construct
  misc_feature 1..106: note = gRNA (spacer + SpCas9)
  source 1..106: mol_type = other RNA
gcagcacagcctagcagccagtttaagagctatgctggaaacagcatagcaagtttaaataaggctagtccgttatcaacttgaaaaagtggcaccgagtcggtgc

SEQ ID NO: 438 - RNA, 106 nt, Synthetic construct
  misc_feature 1..106: note = gRNA (spacer + SpCas9)
  source 1..106: mol_type = other RNA
tcctggaattagaggacaaagtttaagagctatgctggaaacagcatagcaagtttaaataaggctagtccgttatcaacttgaaaaagtggcaccgagtcggtgc

SEQ ID NO: 439 - RNA, 106 nt, Synthetic construct
  misc_feature 1..106: note = gRNA (spacer + SpCas9)
  source 1..106: mol_type = other RNA
gtcttacataagaggactctgtttaagagctatgctggaaacagcatagcaagtttaaataaggctagtccgttatcaacttgaaaaagtggcaccgagtcggtgc

SEQ ID NO: 440 - RNA, 106 nt, Synthetic construct
  misc_feature 1..106: note = gRNA (spacer + SpCas9)
  source 1..106: mol_type = other RNA
ttgtgggtcaccatattcttgtttaagagctatgctggaaacagcatagcaagtttaaataaggctagtccgttatcaacttgaaaaagtggcaccgagtcggtgc

SEQ ID NO: 441 - RNA, 106 nt, Synthetic construct
  misc_feature 1..106: note = gRNA (spacer + SpCas9)
  source 1..106: mol_type = other RNA
cgcaaaatacctatgggagtgtttaagagctatgctggaaacagcatagcaagtttaaataaggctagtccgttatcaacttgaaaaagtggcaccgagtcggtgc

SEQ ID NO: 442 - RNA, 106 nt, Synthetic construct
  misc_feature 1..106: note = gRNA (spacer + SpCas9)
  source 1..106: mol_type = other RNA
gggttgcgtcagcaaacactgtttaagagctatgctggaaacagcatagcaagtttaaataaggctagtccgttatcaacttgaaaaagtggcaccgagtcggtgc

SEQ ID NO: 443 - RNA, 106 nt, Synthetic construct
  misc_feature 1..106: note = gRNA (spacer + SpCas9)
  source 1..106: mol_type = other RNA
agctcttgttcccaagaatagtttaagagctatgctggaaacagcatagcaagtttaaataaggctagtccgttatcaacttgaaaaagtggcaccgagtcggtgc

SEQ ID NO: 444 - RNA, 106 nt, Synthetic construct
  misc_feature 1..106: note = gRNA (spacer + SpCas9)
  source 1..106: mol_type = other RNA
tgacatactttccaatcaatgtttaagagctatgctggaaacagcatagcaagtttaaataaggctagtccgttatcaacttgaaaaagtggcaccgagtcggtgc

SEQ ID NO: 445 - RNA, 106 nt, Synthetic construct
  misc_feature 1..106: note = gRNA (spacer + SpCas9)
  source 1..106: mol_type = other RNA
cagatgagaaggcacagacggtttaagagctatgctggaaacagcatagcaagtttaaataaggctagtccgttatcaacttgaaaaagtggcaccgagtcggtgc

SEQ ID NO: 446 - RNA, 106 nt, Synthetic construct
  misc_feature 1..106: note = gRNA (spacer + SpCas9)
  source 1..106: mol_type = other RNA
ccccgcctgtaacacgagcagtttaagagctatgctggaaacagcatagcaagtttaaataaggctagtccgttatcaacttgaaaaagtggcaccgagtcggtgc

SEQ ID NO: 447 - RNA, 106 nt, Synthetic construct
  misc_feature 1..106: note = gRNA (spacer + SpCas9)
  source 1..106: mol_type = other RNA
gggtggagccctcaggctcagtttaagagctatgctggaaacagcatagcaagtttaaataaggctagtccgttatcaacttgaaaaagtggcaccgagtcggtgc

SEQ ID NO: 448 - RNA, 106 nt, Synthetic construct
  misc_feature 1..106: note = gRNA (spacer + SpCas9)
  source 1..106: mol_type = other RNA
attccttggactcataaggtgtttaagagctatgctggaaacagcatagcaagtttaaataaggctagtccgttatcaacttgaaaaagtggcaccgagtcggtgc

SEQ ID NO: 449 - RNA, 106 nt, Synthetic construct
  misc_feature 1..106: note = gRNA (spacer + SpCas9)
  source 1..106: mol_type = other RNA
tttgtgggtcaccatattctgtttaagagctatgctggaaacagcatagcaagtttaaataaggctagtccgttatcaacttgaaaaagtggcaccgagtcggtgc

SEQ ID NO: 450 - RNA, 106 nt, Synthetic construct
  misc_feature 1..106: note = gRNA (spacer + SpCas9)
  source 1..106: mol_type = other RNA
gtgaaaaagttgcatggtgcgtttaagagctatgctggaaacagcatagcaagtttaaataaggctagtccgttatcaacttgaaaaagtggcaccgagtcggtgc

SEQ ID NO: 451 - RNA, 106 nt, Synthetic construct
  misc_feature 1..106: note = gRNA (spacer + SpCas9)
  source 1..106: mol_type = other RNA
cctgaactggagccaccagcgtttaagagctatgctggaaacagcatagcaagtttaaataaggctagtccgttatcaacttgaaaaagtggcaccgagtcggtgc

SEQ ID NO: 452 - RNA, 106 nt, Synthetic construct
  misc_feature 1..106: note = gRNA (spacer + SpCas9)
  source 1..106: mol_type = other RNA
tcctctgccgatccatactggtttaagagctatgctggaaacagcatagcaagtttaaataaggctagtccgttatcaacttgaaaaagtggcaccgagtcggtgc

SEQ ID NO: 453 - RNA, 106 nt, Synthetic construct
  misc_feature 1..106: note = gRNA (spacer + SpCas9)
  source 1..106: mol_type = other RNA
cggctaggagttccgcagtagtttaagagctatgctggaaacagcatagcaagtttaaataaggctagtccgttatcaacttgaaaaagtggcaccgagtcggtgc

SEQ ID NO: 454 - RNA, 106 nt, Synthetic construct
  misc_feature 1..106: note = gRNA (spacer + SpCas9)
  source 1..106: mol_type = other RNA
aatgtcaacgaccgaccttggtttaagagctatgctggaaacagcatagcaagtttaaataaggctagtccgttatcaacttgaaaaagtggcaccgagtcggtgc

SEQ ID NO: 455 - RNA, 106 nt, Synthetic construct
  misc_feature 1..106: note = gRNA (spacer + SpCas9)
  source 1..106: mol_type = other RNA
gaccttcgtctgcgaggcgagtttaagagctatgctggaaacagcatagcaagtttaaataaggctagtccgttatcaacttgaaaaagtggcaccgagtcggtgc

SEQ ID NO: 456 - RNA, 106 nt, Synthetic construct
  misc_feature 1..106: note = gRNA (spacer + SpCas9)
  source 1..106: mol_type = other RNA
gttgccgggcaacggggtaagtttaagagctatgctggaaacagcatagcaagtttaaataaggctagtccgttatcaacttgaaaaagtggcaccgagtcggtgc

SEQ ID NO: 457 - RNA, 106 nt, Synthetic construct
  misc_feature 1..106: note = gRNA (spacer + SpCas9)
  source 1..106: mol_type = other RNA
gattgagaccttcgtctgcggtttaagagctatgctggaaacagcatagcaagtttaaataaggctagtccgttatcaacttgaaaaagtggcaccgagtcggtgc

SEQ ID NO: 458 - RNA, 106 nt, Synthetic construct
  misc_feature 1..106: note = gRNA (spacer + SpCas9)
  source 1..106: mol_type = other RNA
aggacccctgctcgtgttacgtttaagagctatgctggaaacagcatagcaagtttaaataaggctagtccgttatcaacttgaaaaagtggcaccgagtcggtgc

SEQ ID NO: 459 - RNA, 106 nt, Synthetic construct
  misc_feature 1..106: note = gRNA (spacer + SpCas9)
  source 1..106: mol_type = other RNA
tttgaagtatgcctcaaggtgtttaagagctatgctggaaacagcatagcaagtttaaataaggctagtccgttatcaacttgaaaaagtggcaccgagtcggtgc

SEQ ID NO: 460 - RNA, 106 nt, Synthetic construct
  misc_feature 1..106: note = gRNA (spacer + SpCas9)
  source 1..106: mol_type = other RNA
ccgcttgttttgctcgcagcgtttaagagctatgctggaaacagcatagcaagtttaaataaggctagtccgttatcaacttgaaaaagtggcaccgagtcggtgc

SEQ ID NO: 461 - RNA, 106 nt, Synthetic construct
  misc_feature 1..106: note = gRNA (spacer + SpCas9)
  source 1..106: mol_type = other RNA
tgctaggctgtgctgccaacgtttaagagctatgctggaaacagcatagcaagtttaaataaggctagtccgttatcaacttgaaaaagtggcaccgagtcggtgc

SEQ ID NO: 462 - RNA, 106 nt, Synthetic construct
  misc_feature 1..106: note = gRNA (spacer + SpCas9)
  source 1..106: mol_type = other RNA
tgccgattggtggaggcagggtttaagagctatgctggaaacagcatagcaagtttaaataaggctagtccgttatcaacttgaaaaagtggcaccgagtcggtgc

SEQ ID NO: 463 - RNA, 106 nt, Synthetic construct
  misc_feature 1..106: note = gRNA (spacer + SpCas9)
  source 1..106: mol_type = other RNA
tctttgtactaggaggctgtgtttaagagctatgctggaaacagcatagcaagtttaaataaggctagtccgttatcaacttgaaaaagtggcaccgagtcggtgc

SEQ ID NO: 464 - RNA, 106 nt, Synthetic construct
  misc_feature 1..106: note = gRNA (spacer + SpCas9)
  source 1..106: mol_type = other RNA
cgtcccgcgcaggatccagtgtttaagagctatgctggaaacagcatagcaagtttaaataaggctagtccgttatcaacttgaaaaagtggcaccgagtcggtgc

SEQ ID NO: 465 - RNA, 106 nt, Synthetic construct
  misc_feature 1..106: note = gRNA (spacer + SpCas9)
  source 1..106: mol_type = other RNA
aaagcccaagatgatgggatgtttaagagctatgctggaaacagcatagcaagtttaaataaggctagtccgttatcaacttgaaaaagtggcaccgagtcggtgc

SEQ ID NO: 466 - RNA, 106 nt, Synthetic construct
  misc_feature 1..106: note = gRNA (spacer + SpCas9)
  source 1..106: mol_type = other RNA
gcagatgagaaggcacagacgtttaagagctatgctggaaacagcatagcaagtttaaataaggctagtccgttatcaacttgaaaaagtggcaccgagtcggtgc

SEQ ID NO: 467 - RNA, 106 nt, Synthetic construct
  misc_feature 1..106: note = gRNA (spacer + SpCas9)
  source 1..106: mol_type = other RNA
cgattggtggaggcaggagggtttaagagctatgctggaaacagcatagcaagtttaaataaggctagtccgttatcaacttgaaaaagtggcaccgagtcggtgc

SEQ ID NO: 468 - RNA, 106 nt, Synthetic construct
  misc_feature 1..106: note = gRNA (spacer + SpCas9)
  source 1..106: mol_type = other RNA
aggaggctgtaggcataaatgtttaagagctatgctggaaacagcatagcaagtttaaataaggctagtccgttatcaacttgaaaaagtggcaccgagtcggtgc

SEQ ID NO: 469 - RNA, 106 nt, Synthetic construct
  misc_feature 1..106: note = gRNA (spacer + SpCas9)
  source 1..106: mol_type = other RNA
ccatgccccaaagccacccagtttaagagctatgctggaaacagcatagcaagtttaaataaggctagtccgttatcaacttgaaaaagtggcaccgagtcggtgc

SEQ ID NO: 470 - RNA, 106 nt, Synthetic construct
  misc_feature 1..106: note = gRNA (spacer + SpCas9)
  source 1..106: mol_type = other RNA
aggttggggactgcgaatttgtttaagagctatgctggaaacagcatagcaagtttaaataaggctagtccgttatcaacttgaaaaagtggcaccgagtcggtgc

SEQ ID NO: 471 - RNA, 106 nt, Synthetic construct
  misc_feature 1..106: note = gRNA (spacer + SpCas9)
  source 1..106: mol_type = other RNA
agaccttcgtctgcgaggcggtttaagagctatgctggaaacagcatagcaagtttaaataaggctagtccgttatcaacttgaaaaagtggcaccgagtcggtgc

SEQ ID NO: 472 - RNA, 106 nt, Synthetic construct
  misc_feature 1..106: note = gRNA (spacer + SpCas9)
  source 1..106: mol_type = other RNA
cctggaattagaggacaaacgtttaagagctatgctggaaacagcatagcaagtttaaataaggctagtccgttatcaacttgaaaaagtggcaccgagtcggtgc

SEQ ID NO: 473 - RNA, 106 nt, Synthetic construct
  misc_feature 1..106: note = gRNA (spacer + SpCas9)
  source 1..106: mol_type = other RNA
tttcagttatatggatgatggtttaagagctatgctggaaacagcatagcaagtttaaataaggctagtccgttatcaacttgaaaaagtggcaccgagtcggtgc

SEQ ID NO: 474 - RNA, 106 nt, Synthetic construct
  misc_feature 1..106: note = gRNA (spacer + SpCas9)
  source 1..106: mol_type = other RNA
gtaacacgagcaggggtcctgtttaagagctatgctggaaacagcatagcaagtttaaataaggctagtccgttatcaacttgaaaaagtggcaccgagtcggtgc

SEQ ID NO: 475 - RNA, 106 nt, Synthetic construct
  misc_feature 1..106: note = gRNA (spacer + SpCas9)
  source 1..106: mol_type = other RNA
catcttcttgttggttcttcgtttaagagctatgctggaaacagcatagcaagtttaaataaggctagtccgttatcaacttgaaaaagtggcaccgagtcggtgc

SEQ ID NO: 476 - RNA, 106 nt, Synthetic construct
  misc_feature 1..106: note = gRNA (spacer + SpCas9)
  source 1..106: mol_type = other RNA
cggggagaccgcgtaaagaggtttaagagctatgctggaaacagcatagcaagtttaaataaggctagtccgttatcaacttgaaaaagtggcaccgagtcggtgc

SEQ ID NO: 477 - RNA, 106 nt, Synthetic construct
  misc_feature 1..106: note = gRNA (spacer + SpCas9)
  source 1..106: mol_type = other RNA
ctagactctgtggtattgtggtttaagagctatgctggaaacagcatagcaagtttaaataaggctagtccgttatcaacttgaaaaagtggcaccgagtcggtgc

SEQ ID NO: 478 - RNA, 106 nt, Synthetic construct
  misc_feature 1..106: note = gRNA (spacer + SpCas9)
  source 1..106: mol_type = other RNA
ccctgctcgtgttacaggcggtttaagagctatgctggaaacagcatagcaagtttaaataaggctagtccgttatcaacttgaaaaagtggcaccgagtcggtgc

SEQ ID NO: 479 - RNA, 106 nt, Synthetic construct
  misc_feature 1..106: note = gRNA (spacer + SpCas9)
  source 1..106: mol_type = other RNA
taccacagagtctagactcggtttaagagctatgctggaaacagcatagcaagtttaaataaggctagtccgttatcaacttgaaaaagtggcaccgagtcggtgc

SEQ ID NO: 480 - RNA, 106 nt, Synthetic construct
  misc_feature 1..106: note = gRNA (spacer + SpCas9)
  source 1..106: mol_type = other RNA
tcgcaaaatacctatgggaggtttaagagctatgctggaaacagcatagcaagtttaaataaggctagtccgttatcaacttgaaaaagtggcaccgagtcggtgc

SEQ ID NO: 481 - RNA, 106 nt, Synthetic construct
  misc_feature 1..106: note = gRNA (spacer + SpCas9)
  source 1..106: mol_type = other RNA
gtctgtgccttctcatctgcgtttaagagctatgctggaaacagcatagcaagtttaaataaggctagtccgttatcaacttgaaaaagtggcaccgagtcggtgc

SEQ ID NO: 482 - RNA, 106 nt, Synthetic construct
  misc_feature 1..106: note = gRNA (spacer + SpCas9)
  source 1..106: mol_type = other RNA
acacgtagcgcctcattttggtttaagagctatgctggaaacagcatagcaagtttaaataaggctagtccgttatcaacttgaaaaagtggcaccgagtcggtgc

SEQ ID NO: 483 - RNA, 106 nt, Synthetic construct
  misc_feature 1..106: note = gRNA (spacer + SpCas9)
  source 1..106: mol_type = other RNA
ttggggttgaggtcccaatcgtttaagagctatgctggaaacagcatagcaagtttaaataaggctagtccgttatcaacttgaaaaagtggcaccgagtcggtgc

SEQ ID NO: 484 - RNA, 106 nt, Synthetic construct
  misc_feature 1..106: note = gRNA (spacer + SpCas9)
  source 1..106: mol_type = other RNA
ccccgagacgggtcgtccgcgtttaagagctatgctggaaacagcatagcaagtttaaataaggctagtccgttatcaacttgaaaaagtggcaccgagtcggtgc

SEQ ID NO: 485 - RNA, 106 nt, Synthetic construct
  misc_feature 1..106: note = gRNA (spacer + SpCas9)
  source 1..106: mol_type = other RNA
cctacgaaccactgaacaaagtttaagagctatgctggaaacagcatagcaagtttaaataaggctagtccgttatcaacttgaaaaagtggcaccgagtcggtgc

SEQ ID NO: 486 - RNA, 106 nt, Synthetic construct
  misc_feature 1..106: note = gRNA (spacer + SpCas9)
  source 1..106: mol_type = other RNA
ttacatactctgtggaaggcgtttaagagctatgctggaaacagcatagcaagtttaaataaggctagtccgttatcaacttgaaaaagtggcaccgagtcggtgc

SEQ ID NO: 487 - RNA, 106 nt, Synthetic construct
  misc_feature 1..106: note = gRNA (spacer + SpCas9)
  source 1..106: mol_type = other RNA
acctcctttccatggctgctgtttaagagctatgctggaaacagcatagcaagtttaaataaggctagtccgttatcaacttgaaaaagtggcaccgagtcggtgc

SEQ ID NO: 488 - RNA, 106 nt, Synthetic construct
  misc_feature 1..106: note = gRNA (spacer + SpCas9)
  source 1..106: mol_type = other RNA
gttatcgctggatgtgtctggtttaagagctatgctggaaacagcatagcaagtttaaataaggctagtccgttatcaacttgaaaaagtggcaccgagtcggtgc

SEQ ID NO: 489 - RNA, 106 nt, Synthetic construct
  misc_feature 1..106: note = gRNA (spacer + SpCas9)
  source 1..106: mol_type = other RNA
aacatgagatgattaggcaggtttaagagctatgctggaaacagcatagcaagtttaaataaggctagtccgttatcaacttgaaaaagtggcaccgagtcggtgc

SEQ ID NO: 490 - RNA, 106 nt, Synthetic construct
  misc_feature 1..106: note = gRNA (spacer + SpCas9)
  source 1..106: mol_type = other RNA
acttctctcaattttctagggtttaagagctatgctggaaacagcatagcaagtttaaataaggctagtccgttatcaacttgaaaaagtggcaccgagtcggtgc

SEQ ID NO: 491 - RNA, 106 nt, Synthetic construct
  misc_feature 1..106: note = gRNA (spacer + SpCas9)
  source 1..106: mol_type = other RNA
cactttctcgccaacttacagtttaagagctatgctggaaacagcatagcaagtttaaataaggctagtccgttatcaacttgaaaaagtggcaccgagtcggtgc

SEQ ID NO: 492 - RNA, 106 nt, Synthetic construct
  misc_feature 1..106: note = gRNA (spacer + SpCas9)
  source 1..106: mol_type = other RNA
cataaggtgggaaactttacgtttaagagctatgctggaaacagcatagcaagtttaaataaggctagtccgttatcaacttgaaaaagtggcaccgagtcggtgc

SEQ ID NO: 493 - RNA, 106 nt, Synthetic construct
  misc_feature 1..106: note = gRNA (spacer + SpCas9)
  source 1..106: mol_type = other RNA
ccaaacctcgaaaaggcatggtttaagagctatgctggaaacagcatagcaagtttaaataaggctagtccgttatcaacttgaaaaagtggcaccgagtcggtgc

SEQ ID NO: 494 - RNA, 106 nt, Synthetic construct
  misc_feature 1..106: note = gRNA (spacer + SpCas9)
  source 1..106: mol_type = other RNA
atagaaggaaagaagtcagagtttaagagctatgctggaaacagcatagcaagtttaaataaggctagtccgttatcaacttgaaaaagtggcaccgagtcggtgc

SEQ ID NO: 495 - RNA, 106 nt, Synthetic construct
  misc_feature 1..106: note = gRNA (spacer + SpCas9)
  source 1..106: mol_type = other RNA
gctgctccttttacacaatggtttaagagctatgctggaaacagcatagcaagtttaaataaggctagtccgttatcaacttgaaaaagtggcaccgagtcggtgc

SEQ ID NO: 496 - RNA, 106 nt, Synthetic construct
  misc_feature 1..106: note = gRNA (spacer + SpCas9)
  source 1..106: mol_type = other RNA
gaagcgaagtgcacacggtcgtttaagagctatgctggaaacagcatagcaagtttaaataaggctagtccgttatcaacttgaaaaagtggcaccgagtcggtgc

SEQ ID NO: 497 - RNA, 106 nt, Synthetic construct
  misc_feature 1..106: note = gRNA (spacer + SpCas9)
  source 1..106: mol_type = other RNA
ggatcatcaaccaccagcacgtttaagagctatgctggaaacagcatagcaagtttaaataaggctagtccgttatcaacttgaaaaagtggcaccgagtcggtgc

SEQ ID NO: 498 - RNA, 106 nt, Synthetic construct
  misc_feature 1..106: note = gRNA (spacer + SpCas9)
  source 1..106: mol_type = other RNA
gagccaagagaaacggactggtttaagagctatgctggaaacagcatagcaagtttaaataaggctagtccgttatcaacttgaaaaagtggcaccgagtcggtgc

SEQ ID NO: 499 - RNA, 106 nt, Synthetic construct
  misc_feature 1..106: note = gRNA (spacer + SpCas9)
  source 1..106: mol_type = other RNA
cttcacctctgcacgtcgcagtttaagagctatgctggaaacagcatagcaagtttaaataaggctagtccgttatcaacttgaaaaagtggcaccgagtcggtgc

SEQ ID NO: 500 - RNA, 106 nt, Synthetic construct
  misc_feature 1..106: note = gRNA (spacer + SpCas9)
  source 1..106: mol_type = other RNA
acaatgttccggagactctagtttaagagctatgctggaaacagcatagcaagtttaaataaggctagtccgttatcaacttgaaaaagtggcaccgagtcggtgc

SEQ ID NO: 501 - RNA, 106 nt, Synthetic construct
  misc_feature 1..106: note = gRNA (spacer + SpCas9)
  source 1..106: mol_type = other RNA
tccgcgggattcagcgccgagtttaagagctatgctggaaacagcatagcaagtttaaataaggctagtccgttatcaacttgaaaaagtggcaccgagtcggtgc

SEQ ID NO: 502 - RNA, 106 nt, Synthetic construct
  misc_feature 1..106: note = gRNA (spacer + SpCas9)
  source 1..106: mol_type = other RNA
ttaatgagtgggaggagttggtttaagagctatgctggaaacagcatagcaagtttaaataaggctagtccgttatcaacttgaaaaagtggcaccgagtcggtgc

SEQ ID NO: 503 - RNA, 106 nt, Synthetic construct
  misc_feature 1..106: note = gRNA (spacer + SpCas9)
  source 1..106: mol_type = other RNA
ccaactcaaacaatccagatgtttaagagctatgctggaaacagcatagcaagtttaaataaggctagtccgttatcaacttgaaaaagtggcaccgagtcggtgc

SEQ ID NO: 504 - RNA, 106 nt, Synthetic construct
  misc_feature 1..106: note = gRNA (spacer + SpCas9)
  source 1..106: mol_type = other RNA
gctgccaactggatcctgcggtttaagagctatgctggaaacagcatagcaagtttaaataaggctagtccgttatcaacttgaaaaagtggcaccgagtcggtgc

SEQ ID NO: 505 - RNA, 106 nt, Synthetic construct
  misc_feature 1..106: note = gRNA (spacer + SpCas9)
  source 1..106: mol_type = other RNA
agtctttgaagtatgcctcagtttaagagctatgctggaaacagcatagcaagtttaaataaggctagtccgttatcaacttgaaaaagtggcaccgagtcggtgc

SEQ ID NO: 506 - RNA, 106 nt, Synthetic construct
  misc_feature 1..106: note = gRNA (spacer + SpCas9)
  source 1..106: mol_type = other RNA
tcctgactgccgattggtgggtttaagagctatgctggaaacagcatagcaagtttaaataaggctagtccgttatcaacttgaaaaagtggcaccgagtcggtgc

SEQ ID NO: 507 - RNA, 106 nt, Synthetic construct
  misc_feature 1..106: note = gRNA (spacer + SpCas9)
  source 1..106: mol_type = other RNA
tcttgtcctccaatttgtccgtttaagagctatgctggaaacagcatagcaagtttaaataaggctagtccgttatcaacttgaaaaagtggcaccgagtcggtgc

SEQ ID NO: 508 - RNA, 106 nt, Synthetic construct
  misc_feature 1..106: note = gRNA (spacer + SpCas9)
  source 1..106: mol_type = other RNA
cgataaccaggacaaattgggtttaagagctatgctggaaacagcatagcaagtttaaataaggctagtccgttatcaacttgaaaaagtggcaccgagtcggtgc

SEQ ID NO: 509 - RNA, 106 nt, Synthetic construct
  misc_feature 1..106: note = gRNA (spacer + SpCas9)
  source 1..106: mol_type = other RNA
atttggaagatccagcatccgtttaagagctatgctggaaacagcatagcaagtttaaataaggctagtccgttatcaacttgaaaaagtggcaccgagtcggtgc

SEQ ID NO: 510 - RNA, 106 nt, Synthetic construct
  misc_feature 1..106: note = gRNA (spacer + SpCas9)
  source 1..106: mol_type = other RNA
ctgtttggctttcagttatagtttaagagctatgctggaaacagcatagcaagtttaaataaggctagtccgttatcaacttgaaaaagtggcaccgagtcggtgc

SEQ ID NO: 511 - RNA, 106 nt, Synthetic construct
  misc_feature 1..106: note = gRNA (spacer + SpCas9)
  source 1..106: mol_type = other RNA
ctcctcctgcctccaccaatgtttaagagctatgctggaaacagcatagcaagtttaaataaggctagtccgttatcaacttgaaaaagtggcaccgagtcggtgc

SEQ ID NO: 512 - RNA, 106 nt, Synthetic construct
  misc_feature 1..106: note = gRNA (spacer + SpCas9)
  source 1..106: mol_type = other RNA
gtcatcctcaggccatgcaggtttaagagctatgctggaaacagcatagcaagtttaaataaggctagtccgttatcaacttgaaaaagtggcaccgagtcggtgc

SEQ ID NO: 513 - RNA, 106 nt, Synthetic construct
  misc_feature 1..106: note = gRNA (spacer + SpCas9)
  source 1..106: mol_type = other RNA
ctgccgttccggccgaccacgtttaagagctatgctggaaacagcatagcaagtttaaataaggctagtccgttatcaacttgaaaaagtggcaccgagtcggtgc

SEQ ID NO: 514 - RNA, 106 nt, Synthetic construct
  misc_feature 1..106: note = gRNA (spacer + SpCas9)
  source 1..106: mol_type = other RNA
ccttcctgactgccgattgggtttaagagctatgctggaaacagcatagcaagtttaaataaggctagtccgttatcaacttgaaaaagtggcaccgagtcggtgc

SEQ ID NO: 515 - RNA, 106 nt, Synthetic construct
  misc_feature 1..106: note = gRNA (spacer + SpCas9)
  source 1..106: mol_type = other RNA
acctgcacgactcctgctcagtttaagagctatgctggaaacagcatagcaagtttaaataaggctagtccgttatcaacttgaaaaagtggcaccgagtcggtgc

SEQ ID NO: 516 - RNA, 106 nt, Synthetic construct
  misc_feature 1..106: note = gRNA (spacer + SpCas9)
  source 1..106: mol_type = other RNA
ggcctgtattttcctgctgggtttaagagctatgctggaaacagcatagcaagtttaaataaggctagtccgttatcaacttgaaaaagtggcaccgagtcggtgc

SEQ ID NO: 517 - RNA, 106 nt, Synthetic construct
  misc_feature 1..106: note = gRNA (spacer + SpCas9)
  source 1..106: mol_type = other RNA
aacatagaggttccttgagcgtttaagagctatgctggaaacagcatagcaagtttaaataaggctagtccgttatcaacttgaaaaagtggcaccgagtcggtgc

SEQ ID NO: 518 - RNA, 106 nt, Synthetic construct
  misc_feature 1..106: note = gRNA (spacer + SpCas9)
  source 1..106: mol_type = other RNA
tgccgttccggccgaccacggtttaagagctatgctggaaacagcatagcaagtttaaataaggctagtccgttatcaacttgaaaaagtggcaccgagtcggtgc

SEQ ID NO: 519 - RNA, 106 nt, Synthetic construct
  misc_feature 1..106: note = gRNA (spacer + SpCas9)
  source 1..106: mol_type = other RNA
ataggccatcagcgcatgcggtttaagagctatgctggaaacagcatagcaagtttaaataaggctagtccgttatcaacttgaaaaagtggcaccgagtcggtgc

SEQ ID NO: 520 - RNA, 106 nt, Synthetic construct
  misc_feature 1..106: note = gRNA (spacer + SpCas9)
  source 1..106: mol_type = other RNA
gcctccaccaatcggcagtcgtttaagagctatgctggaaacagcatagcaagtttaaataaggctagtccgttatcaacttgaaaaagtggcaccgagtcggtgc

SEQ ID NO: 521 - RNA, 106 nt, Synthetic construct
  misc_feature 1..106: note = gRNA (spacer + SpCas9)
  source 1..106: mol_type = other RNA
gtcctttgtttacgtcccgtgtttaagagctatgctggaaacagcatagcaagtttaaataaggctagtccgttatcaacttgaaaaagtggcaccgagtcggtgc

SEQ ID NO: 522 - RNA, 106 nt, Synthetic construct
  misc_feature 1..106: note = gRNA (spacer + SpCas9)
  source 1..106: mol_type = other RNA
tgggaacaagagctacagcagtttaagagctatgctggaaacagcatagcaagtttaaataaggctagtccgttatcaacttgaaaaagtggcaccgagtcggtgc

SEQ ID NO: 523 - RNA, 106 nt, Synthetic construct
  misc_feature 1..106: note = gRNA (spacer + SpCas9)
  source 1..106: mol_type = other RNA
ctgtaaacaggcctattgatgtttaagagctatgctggaaacagcatagcaagtttaaataaggctagtccgttatcaacttgaaaaagtggcaccgagtcggtgc

SEQ ID NO: 524 - RNA, 106 nt, Synthetic construct
  misc_feature 1..106: note = gRNA (spacer + SpCas9)
  source 1..106: mol_type = other RNA
gtcgcagaagatctcaatctgtttaagagctatgctggaaacagcatagcaagtttaaataaggctagtccgttatcaacttgaaaaagtggcaccgagtcggtgc

SEQ ID NO: 525 - RNA, 106 nt, Synthetic construct
  misc_feature 1..106: note = gRNA (spacer + SpCas9)
  source 1..106: mol_type = other RNA
ctgccttcctgactgccgatgtttaagagctatgctggaaacagcatagcaagtttaaataaggctagtccgttatcaacttgaaaaagtggcaccgagtcggtgc

SEQ ID NO: 526 - RNA, 106 nt, Synthetic construct
  misc_feature 1..106: note = gRNA (spacer + SpCas9)
  source 1..106: mol_type = other RNA
actactaattccctggatgcgtttaagagctatgctggaaacagcatagcaagtttaaataaggctagtccgttatcaacttgaaaaagtggcaccgagtcggtgc

SEQ ID NO: 527 - RNA, 106 nt, Synthetic construct
  misc_feature 1..106: note = gRNA (spacer + SpCas9)
  source 1..106: mol_type = other RNA
cacatttcttgccttactttgtttaagagctatgctggaaacagcatagcaagtttaaataaggctagtccgttatcaacttgaaaaagtggcaccgagtcggtgc

SEQ ID NO: 528 - RNA, 106 nt, Synthetic construct
  misc_feature 1..106: note = gRNA (spacer + SpCas9)
  source 1..106: mol_type = other RNA
ggatgactgtctcttagagggtttaagagctatgctggaaacagcatagcaagtttaaataaggctagtccgttatcaacttgaaaaagtggcaccgagtcggtgc

SEQ ID NO: 529 - RNA, 106 nt, Synthetic construct
  misc_feature 1..106: note = gRNA (spacer + SpCas9)
  source 1..106: mol_type = other RNA
gctatgcctcatcttcttgtgtttaagagctatgctggaaacagcatagcaagtttaaataaggctagtccgttatcaacttgaaaaagtggcaccgagtcggtgc

SEQ ID NO: 530 - RNA, 106 nt, Synthetic construct
  misc_feature 1..106: note = gRNA (spacer + SpCas9)
  source 1..106: mol_type = other RNA
cccgtcggcgctgaatcccggtttaagagctatgctggaaacagcatagcaagtttaaataaggctagtccgttatcaacttgaaaaagtggcaccgagtcggtgc

SEQ ID NO: 531 - RNA, 106 nt, Synthetic construct
  misc_feature 1..106: note = gRNA (spacer + SpCas9)
  source 1..106: mol_type = other RNA
tagtattccttggactcatagtttaagagctatgctggaaacagcatagcaagtttaaataaggctagtccgttatcaacttgaaaaagtggcaccgagtcggtgc

SEQ ID NO: 532 - RNA, 106 nt, Synthetic construct
  misc_feature 1..106: note = gRNA (spacer + SpCas9)
  source 1..106: mol_type = other RNA
aggtaggagcgggagcattcgtttaagagctatgctggaaacagcatagcaagtttaaataaggctagtccgttatcaacttgaaaaagtggcaccgagtcggtgc

SEQ ID NO: 533 - RNA, 106 nt, Synthetic construct
  misc_feature 1..106: note = gRNA (spacer + SpCas9)
  source 1..106: mol_type = other RNA
tcttttggggtggagccctcgtttaagagctatgctggaaacagcatagcaagtttaaataaggctagtccgttatcaacttgaaaaagtggcaccgagtcggtgc

SEQ ID NO: 534 - RNA, 106 nt, Synthetic construct
  misc_feature 1..106: note = gRNA (spacer + SpCas9)
  source 1..106: mol_type = other RNA
tcagtatgccctgagcctgagtttaagagctatgctggaaacagcatagcaagtttaaataaggctagtccgttatcaacttgaaaaagtggcaccgagtcggtgc

SEQ ID NO: 535 - RNA, 106 nt, Synthetic construct
  misc_feature 1..106: note = gRNA (spacer + SpCas9)
  source 1..106: mol_type = other RNA
tttaatgagtgggaggagttgtttaagagctatgctggaaacagcatagcaagtttaaataaggctagtccgttatcaacttgaaaaagtggcaccgagtcggtgc

SEQ ID NO: 536 - RNA, 106 nt, Synthetic construct
  misc_feature 1..106: note = gRNA (spacer + SpCas9)
  source 1..106: mol_type = other RNA
ctccctcgcctcgcagacgagtttaagagctatgctggaaacagcatagcaagtttaaataaggctagtccgttatcaacttgaaaaagtggcaccgagtcggtgc

SEQ ID NO: 537 - RNA, 106 nt, Synthetic construct
  misc_feature 1..106: note = gRNA (spacer + SpCas9)
  source 1..106: mol_type = other RNA
gataagataggggcatttgggtttaagagctatgctggaaacagcatagcaagtttaaataaggctagtccgttatcaacttgaaaaagtggcaccgagtcggtgc

SEQ ID NO: 538 - RNA, 106 nt, Synthetic construct
  misc_feature 1..106: note = gRNA (spacer + SpCas9)
  source 1..106: mol_type = other RNA
ccgcgggattcagcgccgacgtttaagagctatgctggaaacagcatagcaagtttaaataaggctagtccgttatcaacttgaaaaagtggcaccgagtcggtgc

SEQ ID NO: 539 - RNA, 106 nt, Synthetic construct
  misc_feature 1..106: note = gRNA (spacer + SpCas9)
  source 1..106: mol_type = other RNA
cagcgataaccaggacaaatgtttaagagctatgctggaaacagcatagcaagtttaaataaggctagtccgttatcaacttgaaaaagtggcaccgagtcggtgc

SEQ ID NO: 540 - RNA, 106 nt, Synthetic construct
  misc_feature 1..106: note = gRNA (spacer + SpCas9)
  source 1..106: mol_type = other RNA
caggtaggagtgggagcattgtttaagagctatgctggaaacagcatagcaagtttaaataaggctagtccgttatcaacttgaaaaagtggcaccgagtcggtgc

SEQ ID NO: 541 - RNA, 106 nt, Synthetic construct
  misc_feature 1..106: note = gRNA (spacer + SpCas9)
  source 1..106: mol_type = other RNA
gtttaatgagtgggaggagtgtttaagagctatgctggaaacagcatagcaagtttaaataaggctagtccgttatcaacttgaaaaagtggcaccgagtcggtgc

SEQ ID NO: 542 - RNA, 106 nt, Synthetic construct
  misc_feature 1..106: note = gRNA (spacer + SpCas9)
  source 1..106: mol_type = other RNA
tggtgagtgattggaggttggtttaagagctatgctggaaacagcatagcaagtttaaataaggctagtccgttatcaacttgaaaaagtggcaccgagtcggtgc

SEQ ID NO: 543 - RNA, 106 nt, Synthetic construct
  misc_feature 1..106: note = gRNA (spacer + SpCas9)
  source 1..106: mol_type = other RNA
taatgagtgggaggagttgggtttaagagctatgctggaaacagcatagcaagtttaaataaggctagtccgttatcaacttgaaaaagtggcaccgagtcggtgc

SEQ ID NO: 544 - RNA, 106 nt, Synthetic construct
  misc_feature 1..106: note = gRNA (spacer + SpCas9)
  source 1..106: mol_type = other RNA
actacatgttctggataatagtttaagagctatgctggaaacagcatagcaagtttaaataaggctagtccgttatcaacttgaaaaagtggcaccgagtcggtgc

SEQ ID NO: 545 - RNA, 106 nt, Synthetic construct
  misc_feature 1..106: note = gRNA (spacer + SpCas9)
  source 1..106: mol_type = other RNA
ggcatagcagcaggatgaaggtttaagagctatgctggaaacagcatagcaagtttaaataaggctagtccgttatcaacttgaaaaagtggcaccgagtcggtgc

SEQ ID NO: 546 - RNA, 106 nt, Synthetic construct
  misc_feature 1..106: note = gRNA (spacer + SpCas9)
  source 1..106: mol_type = other RNA
gttgataagataggggcattgtttaagagctatgctggaaacagcatagcaagtttaaataaggctagtccgttatcaacttgaaaaagtggcaccgagtcggtgc

SEQ ID NO: 547 - RNA, 106 nt, Synthetic construct
  misc_feature 1..106: note = gRNA (spacer + SpCas9)
  source 1..106: mol_type = other RNA
tcaacgaattgtgggtctttgtttaagagctatgctggaaacagcatagcaagtttaaataaggctagtccgttatcaacttgaaaaagtggcaccgagtcggtgc

SEQ ID NO: 548 - RNA, 106 nt, Synthetic construct
  misc_feature 1..106: note = gRNA (spacer + SpCas9)
  source 1..106: mol_type = other RNA
tatggatgatgtggtattgggtttaagagctatgctggaaacagcatagcaagtttaaataaggctagtccgttatcaacttgaaaaagtggcaccgagtcggtgc

SEQ ID NO: 549 - RNA, 106 nt, Synthetic construct
  misc_feature 1..106: note = gRNA (spacer + SpCas9)
  source 1..106: mol_type = other RNA
caacgaattgtgggtcttttgtttaagagctatgctggaaacagcatagcaagtttaaataaggctagtccgttatcaacttgaaaaagtggcaccgagtcggtgc

SEQ ID NO: 550 - RNA, 106 nt, Synthetic construct
  misc_feature 1..106: note = gRNA (spacer + SpCas9)
  source 1..106: mol_type = other RNA
catttgttcagtggttcgtagtttaagagctatgctggaaacagcatagcaagtttaaataaggctagtccgttatcaacttgaaaaagtggcaccgagtcggtgc

SEQ ID NO: 551 - RNA, 106 nt, Synthetic construct
  misc_feature 1..106: note = gRNA (spacer + SpCas9)
  source 1..106: mol_type = other RNA
cgtctaacaacagtagtttcgtttaagagctatgctggaaacagcatagcaagtttaaataaggctagtccgttatcaacttgaaaaagtggcaccgagtcggtgc

SEQ ID NO: 552 - RNA, 106 nt, Synthetic construct
  misc_feature 1..106: note = gRNA (spacer + SpCas9)
  source 1..106: mol_type = other RNA
tgcctgagtgctgtatggtggtttaagagctatgctggaaacagcatagcaagtttaaataaggctagtccgttatcaacttgaaaaagtggcaccgagtcggtgc

SEQ ID NO: 553 - RNA, 106 nt, Synthetic construct
  misc_feature 1..106: note = gRNA (spacer + SpCas9)
  source 1..106: mol_type = other RNA
gccccgagacgggtcgtccggtttaagagctatgctggaaacagcatagcaagtttaaataaggctagtccgttatcaacttgaaaaagtggcaccgagtcggtgc

SEQ ID NO: 554 - RNA, 106 nt, Synthetic construct
  misc_feature 1..106: note = gRNA (spacer + SpCas9)
  source 1..106: mol_type = other RNA
gactgccgattggtggaggcgtttaagagctatgctggaaacagcatagcaagtttaaataaggctagtccgttatcaacttgaaaaagtggcaccgagtcggtgc

SEQ ID NO: 555 - RNA, 106 nt, Synthetic construct
  misc_feature 1..106: note = gRNA (spacer + SpCas9)
  source 1..106: mol_type = other RNA
tatatggatgatgtggtattgtttaagagctatgctggaaacagcatagcaagtttaaataaggctagtccgttatcaacttgaaaaagtggcaccgagtcggtgc

SEQ ID NO: 556 - RNA, 106 nt, Synthetic construct
  misc_feature 1..106: note = gRNA (spacer + SpCas9)
  source 1..106: mol_type = other RNA
cttgagtatttggtgtctttgtttaagagctatgctggaaacagcatagcaagtttaaataaggctagtccgttatcaacttgaaaaagtggcaccgagtcggtgc

SEQ ID NO: 557 - RNA, 106 nt, Synthetic construct
  misc_feature 1..106: note = gRNA (spacer + SpCas9)
  source 1..106: mol_type = other RNA
gatctggtgggcgttcacgggtttaagagctatgctggaaacagcatagcaagtttaaataaggctagtccgttatcaacttgaaaaagtggcaccgagtcggtgc

SEQ ID NO: 558 - RNA, 106 nt, Synthetic construct
  misc_feature 1..106: note = gRNA (spacer + SpCas9)
  source 1..106: mol_type = other RNA
agactgggaggagttggggggtttaagagctatgctggaaacagcatagcaagtttaaataaggctagtccgttatcaacttgaaaaagtggcaccgagtcggtgc

SEQ ID NO: 559 - RNA, 106 nt, Synthetic construct
  misc_feature 1..106: note = gRNA (spacer + SpCas9)
  source 1..106: mol_type = other RNA
agtcctcttatgtaagacctgtttaagagctatgctggaaacagcatagcaagtttaaataaggctagtccgttatcaacttgaaaaagtggcaccgagtcggtgc

SEQ ID NO: 560 - RNA, 106 nt, Synthetic construct
  misc_feature 1..106: note = gRNA (spacer + SpCas9)
  source 1..106: mol_type = other RNA
ctcaagatgttgtacagactgtttaagagctatgctggaaacagcatagcaagtttaaataaggctagtccgttatcaacttgaaaaagtggcaccgagtcggtgc

SEQ ID NO: 561 - RNA, 106 nt, Synthetic construct
  misc_feature 1..106: note = gRNA (spacer + SpCas9)
  source 1..106: mol_type = other RNA
gggaacaagagctacagcatgtttaagagctatgctggaaacagcatagcaagtttaaataaggctagtccgttatcaacttgaaaaagtggcaccgagtcggtgc

SEQ ID NO: 562 - RNA, 106 nt, Synthetic construct
  misc_feature 1..106: note = gRNA (spacer + SpCas9)
  source 1..106: mol_type = other RNA
tcgcagaagatctcaatctcgtttaagagctatgctggaaacagcatagcaagtttaaataaggctagtccgttatcaacttgaaaaagtggcaccgagtcggtgc

SEQ ID NO: 563 - RNA, 106 nt, Synthetic construct
  misc_feature 1..106: note = gRNA (spacer + SpCas9)
  source 1..106: mol_type = other RNA
ggggtggagccctcaggctcgtttaagagctatgctggaaacagcatagcaagtttaaataaggctagtccgttatcaacttgaaaaagtggcaccgagtcggtgc

SEQ ID NO: 564 - RNA, 106 nt, Synthetic construct
  misc_feature 1..106: note = gRNA (spacer + SpCas9)
  source 1..106: mol_type = other RNA
tattccttggactcataagggtttaagagctatgctggaaacagcatagcaagtttaaataaggctagtccgttatcaacttgaaaaagtggcaccgagtcggtgc

SEQ ID NO: 565 - RNA, 106 nt, Synthetic construct
  misc_feature 1..106: note = gRNA (spacer + SpCas9)
  source 1..106: mol_type = other RNA
tctaagagacagtcatcctcgtttaagagctatgctggaaacagcatagcaagtttaaataaggctagtccgttatcaacttgaaaaagtggcaccgagtcggtgc

SEQ ID NO: 566 - RNA, 106 nt, Synthetic construct
  misc_feature 1..106: note = gRNA (spacer + SpCas9)
  source 1..106: mol_type = other RNA
caactcaaacaatccagattgtttaagagctatgctggaaacagcatagcaagtttaaataaggctagtccgttatcaacttgaaaaagtggcaccgagtcggtgc

SEQ ID NO: 567 - RNA, 106 nt, Synthetic construct
  misc_feature 1..106: note = gRNA (spacer + SpCas9)
  source 1..106: mol_type = other RNA
aaacaaaggacgtcccgcgcgtttaagagctatgctggaaacagcatagcaagtttaaataaggctagtccgttatcaacttgaaaaagtggcaccgagtcggtgc

SEQ ID NO: 568 - RNA, 106 nt, Synthetic construct
  misc_feature 1..106: note = gRNA (spacer + SpCas9)
  source 1..106: mol_type = other RNA
ctgccaactggatcctgcgcgtttaagagctatgctggaaacagcatagcaagtttaaataaggctagtccgttatcaacttgaaaaagtggcaccgagtcggtgc

SEQ ID NO: 569 - RNA, 106 nt, Synthetic construct
  misc_feature 1..106: note = gRNA (spacer + SpCas9)
  source 1..106: mol_type = other RNA
gaagctccaaattctttatagtttaagagctatgctggaaacagcatagcaagtttaaataaggctagtccgttatcaacttgaaaaagtggcaccgagtcggtgc

SEQ ID NO: 570 - RNA, 106 nt, Synthetic construct
  misc_feature 1..106: note = gRNA (spacer + SpCas9)
  source 1..106: mol_type = other RNA
gtcagtatgccctgagcctggtttaagagctatgctggaaacagcatagcaagtttaaataaggctagtccgttatcaacttgaaaaagtggcaccgagtcggtgc

SEQ ID NO: 571 - RNA, 106 nt, Synthetic construct
  misc_feature 1..106: note = gRNA (spacer + SpCas9)
  source 1..106: mol_type = other RNA
tttcccaccttatgagtccagtttaagagctatgctggaaacagcatagcaagtttaaataaggctagtccgttatcaacttgaaaaagtggcaccgagtcggtgc

SEQ ID NO: 572 - RNA, 106 nt, Synthetic construct
  misc_feature 1..106: note = gRNA (spacer + SpCas9)
  source 1..106: mol_type = other RNA
acaagaggttggtgagtgatgtttaagagctatgctggaaacagcatagcaagtttaaataaggctagtccgttatcaacttgaaaaagtggcaccgagtcggtgc

SEQ ID NO: 573 - RNA, 106 nt, Synthetic construct
  misc_feature 1..106: note = gRNA (spacer + SpCas9)
  source 1..106: mol_type = other RNA
gaaagcccaagatgatgggagtttaagagctatgctggaaacagcatagcaagtttaaataaggctagtccgttatcaacttgaaaaagtggcaccgagtcggtgc

SEQ ID NO: 574 - RNA, 106 nt, Synthetic construct
  misc_feature 1..106: note = gRNA (spacer + SpCas9)
  source 1..106: mol_type = other RNA
aggttccacgcatgcgctgagtttaagagctatgctggaaacagcatagcaagtttaaataaggctagtccgttatcaacttgaaaaagtggcaccgagtcggtgc

SEQ ID NO: 575 - RNA, 106 nt, Synthetic construct
  misc_feature 1..106: note = gRNA (spacer + SpCas9)
  source 1..106: mol_type = other RNA
ttggtgagtgattggaggttgtttaagagctatgctggaaacagcatagcaagtttaaataaggctagtccgttatcaacttgaaaaagtggcaccgagtcggtgc

SEQ ID NO: 576 - RNA, 106 nt, Synthetic construct
  misc_feature 1..106: note = gRNA (spacer + SpCas9)
  source 1..106: mol_type = other RNA
agagctacagcatgggaggtgtttaagagctatgctggaaacagcatagcaagtttaaataaggctagtccgttatcaacttgaaaaagtggcaccgagtcggtgc

SEQ ID NO: 577 - RNA, 106 nt, Synthetic construct
  misc_feature 1..106: note = gRNA (spacer + SpCas9)
  source 1..106: mol_type = other RNA
atatggatgatgtggtattggtttaagagctatgctggaaacagcatagcaagtttaaataaggctagtccgttatcaacttgaaaaagtggcaccgagtcggtgc

SEQ ID NO: 578 - RNA, 106 nt, Synthetic construct
  misc_feature 1..106: note = gRNA (spacer + SpCas9)
  source 1..106: mol_type = other RNA
ccatttgttcagtggttcgtgtttaagagctatgctggaaacagcatagcaagtttaaataaggctagtccgttatcaacttgaaaaagtggcaccgagtcggtgc

SEQ ID NO: 579 - RNA, 106 nt, Synthetic construct
  misc_feature 1..106: note = gRNA (spacer + SpCas9)
  source 1..106: mol_type = other RNA
ttatatggatgatgtggtatgtttaagagctatgctggaaacagcatagcaagtttaaataaggctagtccgttatcaacttgaaaaagtggcaccgagtcggtgc

SEQ ID NO: 580 - RNA, 106 nt, Synthetic construct
  misc_feature 1..106: note = gRNA (spacer + SpCas9)
  source 1..106: mol_type = other RNA
ggagtgggagcattcgggccgtttaagagctatgctggaaacagcatagcaagtttaaataaggctagtccgttatcaacttgaaaaagtggcaccgagtcggtgc

SEQ ID NO: 581 - RNA, 106 nt, Synthetic construct
  misc_feature 1..106: note = gRNA (spacer + SpCas9)
  source 1..106: mol_type = other RNA
atttggtgtcttttggagtggtttaagagctatgctggaaacagcatagcaagtttaaataaggctagtccgttatcaacttgaaaaagtggcaccgagtcggtgc

SEQ ID NO: 582 - RNA, 106 nt, Synthetic construct
  misc_feature 1..106: note = gRNA (spacer + SpCas9)
  source 1..106: mol_type = other RNA
cacagaaaggccttgtaagtgtttaagagctatgctggaaacagcatagcaagtttaaataaggctagtccgttatcaacttgaaaaagtggcaccgagtcggtgc

SEQ ID NO: 583 - RNA, 106 nt, Synthetic construct
  misc_feature 1..106: note = gRNA (spacer + SpCas9)
  source 1..106: mol_type = other RNA
accaattttcttttgtctttgtttaagagctatgctggaaacagcatagcaagtttaaataaggctagtccgttatcaacttgaaaaagtggcaccgagtcggtgc

SEQ ID NO: 584 - RNA, 106 nt, Synthetic construct
  misc_feature 1..106: note = gRNA (spacer + SpCas9)
  source 1..106: mol_type = other RNA
aggttaatggtctttgtactgtttaagagctatgctggaaacagcatagcaagtttaaataaggctagtccgttatcaacttgaaaaagtggcaccgagtcggtgc

SEQ ID NO: 585 - RNA, 106 nt, Synthetic construct
  misc_feature 1..106: note = gRNA (spacer + SpCas9)
  source 1..106: mol_type = other RNA
taccaattttcttttgtcttgtttaagagctatgctggaaacagcatagcaagtttaaataaggctagtccgttatcaacttgaaaaagtggcaccgagtcggtgc

SEQ ID NO: 586 - DNA, 86 bp, synthetic construct
  source 1..86: mol_type = other DNA
  misc_feature 1..86: note = SpCas9 gRNA scaffold sequence (DNA)
gtttaagagctatgctggaaacagcatagcaagtttaaataaggctagtccgttatcaacttgaaaaagtggcaccgagtcggtgc

SEQ ID NO: 587 - RNA, 86 nt, Synthetic construct
  misc_feature 1..86: note = SpCas9 gRNA scaffold sequence (RNA)
  source 1..86: mol_type = other RNA
gtttaagagctatgctggaaacagcatagcaagtttaaataaggctagtccgttatcaacttgaaaaagtggcaccgagtcggtgc

SEQ ID NO: 588-589 - skipped (2 entries)

SEQ ID NO: 590 - protein, 65 aa, Synthetic construct
  REGION 1..65: note = KRAB (AA)
RTLVTFKDVFVDFTREEWKLLDTAQQILYRNVMLENYKNLVSLGYQLTKPDVILRLEKGEEPWLV

SEQ ID NO: 591 - DNA, 195 bp, Synthetic construct
  misc_feature 1..195: note = KRAB (nt)
  source 1..195: mol_type = other DNA
cggacactggtgaccttcaaggatgtgtttgtggacttcaccagggaggagtggaagctgctggacactgctcagcagatcctgtacagaaatgtgatgctggagaactataagaacctggtttccttgggttatcagcttactaagccagatgtgatcctccggttggagaagggagaagagccctggctggtg

SEQ ID NO: 592 - protein, 16 aa, Synthetic construct
  REGION 1..16: note = NLS (AA)
KRPAATKKAGQAKKKK

SEQ ID NO: 593 - protein, 7 aa, Synthetic construct
  REGION 1..7: note = NLS-2 (AA)
PKKKRKV

SEQ ID NO: 594 - DNA, 4509 bp, Synthetic construct
  misc_feature 1..4509: note = NLS2-dSpCas9-NLS-KRAB-NLS2 (nt)
  source 1..4509: mol_type = other DNA
ccaaagaagaagcggaaggtcggtatccacggagtcccagcagccgacaagaagtactccattgggctcgccatcggcacaaacagcgtcggctgggccgtcattacggacgagtacaaggtgccgagcaaaaaattcaaagttctgggcaataccgatcgccacagcataaagaagaacctcattggcgccctcctgttcgactccggggaaaccgccgaagccacgcggctcaaaagaacagcacggcgcagatatacccgcagaaagaatcggatctgctacctgcaggagatctttagtaatgagatggctaaggtggatgactctttcttccataggctggaggagtcctttttggtggaggaggataaaaagcacgagcgccacccaatctttggcaatatcgtggacgaggtggcgtaccatgaaaagtacccaaccatatatcatctgaggaagaagcttgtagacagtactgataaggctgacttgcggttgatctatctcgcgctggcgcatatgatcaaatttcggggacacttcctcatcgagggggacctgaacccagacaacagcgatgtcgacaaactctttatccaactggttcagacttacaatcagcttttcgaagagaacccgatcaacgcatccggagttgacgccaaagcaatcctgagcgctaggctgtccaaatcccggcggctcgaaaacctcatcgcacagctccctggggagaagaagaacggcctgtttggtaatcttatcgccctgtcactcgggctgacccccaactttaaatctaacttcgacctggccgaagatgccaagcttcaactgagcaaagacacctacgatgatgatctcgacaatctgctggcccagatcggcgaccagtacgcagacctttttttggcggcaaagaacctgtcagacgccattctgctgagtgatattctgcgagtgaacacggagatcaccaaagctccgctgagcgctagtatgatcaagcgctatgatgagcaccaccaagacttgactttgctgaaggcccttgtcagacagcaactgcctgagaagtacaaggaaattttcttcgatcagtctaaaaatggctacgccggatacattgacggcggagcaagccaggaggaattttacaaatttattaagcccatcttggaaaaaatggacggcaccgaggagctgctggtaaagcttaacagagaagatctgttgcgcaaacagcgcactttcgacaatggaagcatcccccaccagattcacctgggcgaactgcacgctatcctcaggcggcaagaggatttctacccctttttgaaagataacagggaaaagattgagaaaatcctcacatttcggataccctactatgtaggccccctcgcccggggaaattccagattcgcgtggatgactcgcaaatcagaagagaccatcactccctggaacttcgaggaagtcgtggataagggggcctctgcccagtccttcatcgaaaggatgactaactttgataaaaatctgcctaacgaaaaggtgcttcctaaacactctctgctgtacgagtacttcacagtttataacgagctcaccaaggtcaaatacgtcacagaagggatgagaaagccagcattcctgtctggagagcagaagaaagctatcgtggacctcctcttcaagacgaaccggaaagttaccgtgaaacagctcaaagaagactatttcaaaaagattgaatgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatgccatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacaaaaggccggcggccacgaaaaaggccggccaggcaaaaaagaaaaaggctagcgatgctaagtcactgactgcctggtcccggacactggtgaccttcaaggatgtgtttgtggacttcaccagggaggagtggaagctgctggacactgctcagcagatcctgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagttccgaaaaagaaacgcaaagtt

SEQ ID NO: 595 - protein, 1503 aa, Synthetic construct
  REGION 1..1503: note = NLS2-dSpCas9-NLS-KRAB-NLS2 (AA)
PKKKRKVGIHGVPAADKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPAATKKAGQAKKKKASDAKSLTAWSRTLVTFKDVFVDFTREEWKLLDTAQQILYRNVMLENYKNLVSLGYQLTKPDVILRLEKGEEPWLVEREIHQETHPDSETAFEIKSSVPKKKRKV

SEQ ID NO: 596 - protein, 1053 aa, Synthetic construct
  REGION 1..1053: note = SaCas9 (AA)
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 597 - protein, 1052 aa, Synthetic construct
  REGION 1..1052: note = dSaCas9 (AA)
KRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 598 - protein, 1368 aa, Synthetic construct [sequence omitted]

SEQ ID NO: 599 - protein, 1367 aa, Synthetic construct
  REGION 1..1367: note = dSpCas9 (AA)
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 600 - protein, 548 aa, Synthetic construct
  REGION 1..548: note = ERF domain (AA)
MKTPADTGFAFPDWAYKPESSPGSRQIQLWHFILELLRKEEYQGVIAWQGDYGEFVIKDPDEVARLWGVRKCKPQMNYDKLSRALRYYYNKRILHKTKGKRFTYKFNFNKLVLVNYPFIDVGLAGGAVPQSAPPVPSGGSHFRFPPSTPSEVLSPTEDPRSPPACSSSSSSLFSAVVARRLGRGSVSDCSDGTSELEEPLGEDPRARPPGPPDLGAFRGPPLARLPHDPGVFRVYPRPRGGPEPLSPFPVSPLAGPGSLLPPQLSPALPMTPTHLAYTPSPTLSPMYPSGGGGPSGSGGGSHFSFSPEDMKRYLQAHTQSVYNYHLSPRAFLHYPGLVVPQPQRPDKCPLPPMAPETPPVPSSASSSSSSSSSPFKFKLQPPPLGRRQRAAGEKAVAGADKSGGSAGGLAEGAGALAPPPPPPQIKVEPISEGESEEVEVTDISDEDEEDGEVFKTPRAPPAPPKPEPGEAPGASQCMPLKLRFKRRWSEDCRLEGGGGPAGGFEDEGEDKKVRGEGPGEAGGPLTPRRVSSDLQHATAQLSLEHRDS

SEQ ID NO: 601 - protein, 228 aa, Synthetic construct
  REGION 1..228: note = MXI1 domain (AA)
MERVKMINVQRLLEAAEFLERRERECEHGYASSFPSMPSPRLQHSKPPRRLSRAQKHSSGSSNTSTANRSTHNELEKNRRAHLRLCLERLKVLIPLGPDCTRHTTLGLLNKAKAHIKKLEEAERKSQHQLENLEREQRFLKWRLEQLQGPQEMERIRMDSIGSTISSDRSDSEREEIEVDVESTEFSHGEVDNISTTSISDIDDHSSLPSIGSDEGYSSASVKLSFTS

SEQ ID NO: 602 - protein, 144 aa, Synthetic construct
  REGION 1..144: note = SID4X domain (AA)
ASPKKKRKVEASGSGMNIQMLLEAADYLERREREAEHGYASMLPGSGMNIQMLLEAADYLERREREAEHGYASMLPGSGMNIQMLLEAADYLERREREAEHGYASMLPGSGMNIQMLLEAADYLERREREAEHGYASMLPSRSR

SEQ ID NO: 603 - protein, 220 aa, Synthetic construct
  REGION 1..220: note = MAD-SID domain (AA)
MAAAVRMNIQMLLEAADYLERREREAEHGYASMLPYNNKDRDALKRRNKSKKNNSSSRSTHNEMEKNRRAHLRLCLEKLKGLVPLGPESSRHTTLSLLTKAKLHIKKLEDCDRKAVHQIDQLQREQRHLKRQLEKLGIERIRMDSIGSTVSSERSDSDREEIDVDVESTDYLTGDLDWSSSSVSDSDERGSMQSLGSDEGYSSTSIKRIKLQDSHKACLG

SEQ ID NO: 604 - protein, 910 aa, Synthetic construct
  REGION 1..910: note = DNMT3A (AA)
MPAMPSSGPGDTSSSAAEREEDRKDGEEQEEPRGKEERQEPSTTARKVGRPGRKRKHPPVESGDTPKDPAVISKSPSMAQDSGASELLPNGDLEKRSEPQPEEGSPAGGQKGGAPAEGEGAAETLPEASRAVENGCCTPKEGRGAPAEAGKEQKETNIESMKMEGSRGRLRGGLGWESSLRQRPMPRLTFQAGDPYYISKRKRDEWLARWKREAEKKAKVIAGMNAVEENQGPGESQKVEEASPPAVQQPTDPASPTVATTPEPVGSDAGDKNATKAGDDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPVCHDSDESDTAKAVEVQNKPMIEWALGGFQPSGPKGLEPPEEEKNPYKEVYTDMWVEPEAAAYAPPPPAKKPRKSTAEKPKVKEIIDERTRERLVYEVRQKCRNIEDICISCGSLNVTLEHPLFVGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFA

SEQ ID NO: 605 - protein, 853 aa, Synthetic construct
  REGION 1..853: note = DNMT3B (AA)
MKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPVVNKSKVRRAGSRKLESRKYENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRPVIASKNDKLELQDCLEYNRIAKLKKVQTITTKSNSIKQGKNQLFPVVMNGKEDVLWCTELERIFGFPVHYTDVSNMGRGARQKLLGRSWSVPVIRHLFAPLKDYFACE

SEQ ID NO: 606 - protein, 852 aa, Synthetic construct
  REGION 1..852: note = LSD1 (AA)
MLSGKKAAAAAAAAAAAATGTEAGPGTAGGSENGSEVAAQPAGLSGPAEVGPGAVGERTPRKKEPPRASPPGGLAEPPGSAGPQAGPTVVPGSATPMETGIAETPEGRRTSRRKRAKVEYREMDESLANLSEDEYYSEEERNAKAEKEKKLPPPPPQAPPEEENESEPEEPSGVEGAAFQSRLPHDRMTSQEAACFPDIISGPQQTQKVFLFIRNRTLQLWLDNPKIQLTFEATLQQLEAPYNSDTVLVHRVHSYLERHGLINFGIYKRIKPLPTKKTGKVIIIGSGVSGLAAARQLQSFGMDVTLLEARDRVGGRVATFRKGNYVADLGAMVVTGLGGNPMAVVSKQVNMELAKIKQKCPLYEANGQAVPKEKDEMVEQEFNRLLEATSYLSHQLDFNVLNNKPVSLGQALEVVIQLQEKHVKDEQIEHWKKIVKTQEELKELLNKMVNLKEKIKELHQQYKEASEVKPPRDITAEFLVKSKHRDLTALCKEYDELAETQGKLEEKLQELEANPPSDVYLSSRDRQILDWHFANLEFANATPLSTLSLKHWDQDDDFEFTGSHLTVRNGYSCVPVALAEGLDIKLNTAVRQVRYTASGCEVIAVNTRSTSQTFIYKCDAVLCTLPLGVLKQQPPAVQFVPPLPEWKTSAVQRMGFGNLNKVVLCFDRVFWDPSVNLFGHVGSTTASRGELFLFWNLYKAPILLALVAGEAAGIMENISDDVIVGRCLAILKGIFGSSAVPQPKETVVSRWRADPWARGSYSYVAAGSSGNDYDLMAQPITPGPSIPGAPQPIPRLFFAGEHTIRNYPATVHGALLSGLREAGRIADQFLGAMYTLPRQATPGVPAQQSPSM

SEQ ID NO: 607 - protein, 384 aa, Synthetic construct
  REGION 1..384: note = DNMT3L
MAAIPALDPEAEPSMDVILVGSSELSSSVSPGTGRDLIAYEVKANQRNIEDICICCGSLQVHTQHPLFEGGICAPCKDKFLDALFLYDDDGYQSYCSICSGETLLICGNPDCTRCYCFECVDSLVGPGTSGKVHAMSNWVCYLCLPSSSGLLQRRRKWRSQLKAFYDRESENPLEMFETVPVWRRQPVRVLSLFEDIKKELTSLGFLESGSDPGQLKHVVDVTDTVRKDVEEWGPFDLVYGATPPLGHTCDRPPSWYLFQFHRLLQYARPKPGSPRPFFWMFVDNLVLNKEDLDVASRFLEMEPVTIPDVHGGSLQNAVRVWSNIPAIRSRHWALVSEEELSLLAQNKQSSKLAAKWPTKLVKNCFLPLREYFKYFSTELTSSL

SEQ ID NO: 608 - protein, 746 aa, Synthetic construct
  REGION 1..746: note = EZH2 (AA)
MGQTGKKSEKGPVCWRKRVKSEYMRLRQLKRFRRADEVKTMFSSNRQKILERTETLNQEWKQRRIQPVHIMTSVSSLRGTRECSVTSDLDFPAQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPDEREEKQKDLEDNRDDKETCPPRKFPADKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTISVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPVPTEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 609 - protein, 5 aa, Synthetic construct
  REGION 1..5: note = GGGGS linker (AA)
GGGGS

SEQ ID NO: 610 - protein, 5 aa, Synthetic construct
  REGION 1..5: note = GGGGG linker (AA)
GGGGG

SEQ ID NO: 611 - protein, 5 aa, Synthetic construct
  REGION 1..5: note = GGAGG linker (AA)
GGAGG

SEQ ID NO: 612 - protein, 7 aa, Synthetic construct
  REGION 1..7: note = GGGGSSS linker (AA)
GGGGSSS

SEQ ID NO: 613 - protein, 7 aa, Synthetic construct
  REGION 1..7: note = GGGGAAA linker (AA)
GGGGAAA

SEQ ID NO: 614 - protein, 7 aa, Synthetic construct
  REGION 1..7: note = NLS - SV40 (AA)
PKKKRKV

SEQ ID NO: 615 - protein, 9 aa, Synthetic construct
  REGION 1..9: note = NLS - cMyc (AA)
PAAKRVKLD

SEQ ID NO: 616 - protein, 11 aa, Synthetic construct
  REGION 1..11: note = NLS - cMyc (AA)
RQRRNELKRSP

SEQ ID NO: 617 - protein, 38 aa, Synthetic construct
  REGION 1..38: note = NLS - hRNPA1 M9 (AA)
NQSSNFGPMKGGNFGGRSSGPYGGGGQYFAKPRNQGGY

SEQ ID NO: 618 - protein, 42 aa, Synthetic construct
  REGION 1..42: note = NLS - IBB domain importin-alpha (AA)
RMRIZFKNKGKDTAELRRRRVEVSVELRKAKKDEQILKRRNV

SEQ ID NO: 619 - protein, 8 aa, Synthetic construct
  REGION 1..8: note = NLS - myoma T protein (AA)
VSRKRPRP

SEQ ID NO: 620 - protein, 8 aa, Synthetic construct
  REGION 1..8: note = NLS - myoma T protein (AA)
PPKKARED

SEQ ID NO: 621 - protein, 8 aa, Homo sapiens
  REGION 1..8: note = NLS - human p53 (AA)
PQPKKKPL

SEQ ID NO: 622 - protein, 12 aa, Mus musculus
  REGION 1..12: note = NLS - mouse c-abl IV (AA)
SALIKKKKKMAP

SEQ ID NO: 623 - protein, 5 aa, Synthetic construct
  REGION 1..5: note = NLS - influenza NS1 (AA)
DRLRR

SEQ ID NO: 624 - protein, 7 aa, Synthetic construct
  REGION 1..7: note = NLS - influenza NS1 (AA)
PKQKKRK

SEQ ID NO: 625 - protein, 10 aa, Synthetic construct
  REGION 1..10: note = NLS - hepatitis delta antigen (AA)
RKLKKKIKKL

SEQ ID NO: 626 - protein, 10 aa, Mus musculus
  REGION 1..10: note = NLS - mouse Mx1 (AA)
REKKKFLKRR

SEQ ID NO: 627 - protein, 20 aa, Homo sapiens
  REGION 1..20: note = NLS - human poly(ADP-ribose) polymerase (AA)
KRKGDEVDGVDEVAKKKSKK

SEQ ID NO: 628 - protein, 17 aa, Synthetic construct
  REGION 1..17: note = NLS - glucocorticoid (AA)
RKCLQAGMNLEARKTKK

SEQ ID NO: 629-640 - skipped (12 entries)

SEQ ID NO: 641 - protein, 22 aa, Synthetic construct
  REGION 1..22: note = SunTag GCN4 peptide (AA)
LLPKNYHLENEVARLKKLVGER

SEQ ID NO: 642 - protein, 5 aa, Synthetic construct
  REGION 1..5: note = Linker (AA)
GGSGG

SEQ ID NO: 643 - protein, 80 aa, Synthetic construct
  REGION 1..80: note = XTEN80 (aa)
GGPSSGAPPPSGGSPAGSPTSTEEGTSESATPESGPGTSTEPSEGSAPGSPAGSPTSTEEGTSTEPSEGSAPGTSTEPSE

SEQ ID NO: 644 - DNA, 6276 bp, Synthetic construct
  misc_feature 1..6276: note = DNMT3A/L-dCas9-KRAB (nt)
  source 1..6276: mol_type = other DNA
atggactacaaagaccatgacggtgattataaagatcatgacatcgattacaaggatgacgatgacaagcacgttaaccacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactggaggcaagcggatccggaagggcatctcctggaatcccaggaagcacccgcaaccccaagaagaagcggaaggtgggcatccacggcgtgcccgccgccgacaagaagtacagcatcggcctggccatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggacgccatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgacagcggcggcaagcggcccgccgccaccaagaaggccggccaggccaagaagaagaaggctagcgatgctaagtcactgactgcctggtcccggacactggtgaccttcaaggatgtgtttgtggacttcaccagggaggagtggaagctgctggacactgctcagcagatcctgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagttccgaaaaagaaacgcaaagtt

SEQ ID NO: 645 - protein, 2092 aa, Synthetic construct
  REGION 1..2092: note = DNMT3A/L-dSpCas9-KRAB(AA)
MDYKDHDGDYKDHDIDYKDDDDKHVNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLEASGSGRASPGIPGSTRNPKKKRKVGIHGVPAADKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGKRPAATKKAGQAKKKKASDAKSLTAWSRTLVTFKDVFVDFTREEWKLLDTAQQILYRNVMLENYKNLVSLGYQLTKPDVILRLEKGEEPWLVEREIHQETHPDSETAFEIKSSVPKKKRKV

SEQ ID NO: 646 - DNA, 6399 bp, Synthetic construct
  misc_feature 1..6399: note = DNMT3A/L-XTEN80-dSpCas9-KRAB (nt)
  source 1..6399: mol_type = other DNA
atgaaccacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgaggttaaccccaagaagaagcggaaggtgggcatccacggcgtgcccgccgccgacaagaagtacagcatcggcctggccatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggacgccatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgacagcggcggcaagcggcccgccgccaccaagaaggccggccaggccaagaagaagaaggctagcgatgctaagtcactgactgcctggtcccggacactggtgaccttcaaggatgtgtttgtggacttcaccagggaggagtggaagctgctggacactgctcagcagatcctgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagttccgaaaaagaaacgcaaagtttag

SEQ ID NO: 647 - protein, 2132 aa, Synthetic construct
  REGION 1..2132: note = DNMT3A/L-XTEN80-dSpCas9-KRAB (AA)
MNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEVNPKKKRKVGIHGVPAADKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGKRPAATKKAGQAKKKKASDAKSLTAWSRTLVTFKDVFVDFTREEWKLLDTAQQILYRNVMLENYKNLVSLGYQLTKPDVILRLEKGEEPWLVEREIHQETHPDSETAFEIKSSVPKKKRKV

SEQ ID NO: 648 - DNA, 6399 bp, Synthetic construct
  misc_feature 1..6399: note = DNMT3A/L(CRISPROFF)-XTEN80-dSpCas9-KRAB (nt)
  source 1..6399: mol_type = other DNA
agtaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgaggttaaccccaagaagaagcggaaggtgggcatccacggcgtgcccgccgccgacaagaagtacagcatcggcctggccatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggacgccatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgacagcggcggcaagcggcccgccgccaccaagaaggccggccaggccaagaagaagaaggctagcgatgctaagtcactgactgcctggtcccggacactggtgaccttcaaggatgtgtttgtggacttcaccagggaggagtggaagctgctggacactgctcagcagatcctgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagttccgaaaaagaaacgcaaagtttag

SEQ ID NO: 649 - protein, 2132 aa, Synthetic construct
  REGION 1..2132: note = DNMT3A/L(CRISPROFF)-XTEN80-dSpCas9-KRAB (AA)
SNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEVNPKKKRKVGIHGVPAADKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGKRPAATKKAGQAKKKKASDAKSLTAWSRTLVTFKDVFVDFTREEWKLLDTAQQILYRNVMLENYKNLVSLGYQLTKPDVILRLEKGEEPWLVEREIHQETHPDSETAFEIKSSVPKKKRKV

SEQ ID NO: 650 - DNA, 3182 bp, Hepatitis B virus
  misc_feature 1..3182: note = Hepatitis B Virus genome (Hepatitis B virus subtype ayw, complete genome, GenBank: U95551.1),
  source 1..3182: mol_type = unassigned DNA
aattccacaacctttcaccaaactctgcaagatcccagagtgagaggcctgtatttccctgctggtggctccagttcaggagcagtaaaccctgttccgactactgcctctcccttatcgtcaatcttctcgaggattggggaccctgcgctgaacatggagaacatcacatcaggattcctaggaccccttctcgtgttacaggcggggtttttcttgttgacaagaatcctcacaataccgcagagtctagactcgtggtggacttctctcaattttctagggggaactaccgtgtgtcttggccaaaattcgcagtccccaacctccaatcactcaccaacctcctgtcctccaacttgtcctggttatcgctggatgtgtctgcggcgttttatcatcttcctcttcatcctgctgctatgcctcatcttcttgttggttcttctggactatcaaggtatgttgcccgtttgtcctctaattccaggatcctcaaccaccagcacgggaccatgccgaacctgcatgactactgctcaaggaacctctatgtatccctcctgttgctgtaccaaaccttcggacggaaattgcacctgtattcccatcccatcatcctgggctttcggaaaattcctatgggagtgggcctcagcccgtttctcctggctcagtttactagtgccatttgttcagtggttcgtagggctttcccccactgtttggctttcagttatatggatgatgtggtattgggggccaagtctgtacagcatcttgagtccctttttaccgctgttaccaattttcttttgtctttgggtatacatttaaaccctaacaaaacaaagagatggggttactctctgaattttatgggttatgtcattggaagttatgggtccttgccacaagaacacatcatacaaaaaatcaaagaatgttttagaaaacttcctattaacaggcctattgattggaaagtatgtcaacgaattgtgggtcttttgggttttgctgccccatttacacaatgtggttatcctgcgttaatgcccttgtatgcatgtattcaatctaagcaggctttcactttctcgccaacttacaaggcctttctgtgtaaacaatacctgaacctttaccccgttgcccggcaacggccaggtctgtgccaagtgtttgctgacgcaacccccactggctggggcttggtcatgggccatcagcgcgtgcgtggaaccttttcggctcctctgccgatccatactgcggaactcctagccgcttgttttgctcgcagcaggtctggagcaaacattatcgggactgataactctgttgtcctctcccgcaaatatacatcgtatccatggctgctaggctgtgctgccaactggatcctgcgcgggacgtcctttgtttacgtcccgtcggcgctgaatcctgcggacgacccttctcggggtcgcttgggactctctcgtccccttctccgtctgccgttccgaccgaccacggggcgcacctctctttacgcggactccccgtctgtgccttctcatctgccggaccgtgtgcacttcgcttcacctctgcacgtcgcatggagaccaccgtgaacgcccaccgaatgttgcccaaggtcttacataagaggactcttggactctctgcaatgtcaacgaccgaccttgaggcatacttcaaagactgtttgtttaaagactgggaggagttgggggaggagattagattaaaggtctttgtactaggaggctgtaggcataaattggtctgcgcaccagcaccatgcaactttttcacctctgcctaatcatctcttgttcatgtcctactgttcaagcctccaagctgtgccttgggtggctttggggcatggacatcgacccttataaagaatttggagctactgtggagttactctcgtttttgccttctgacttctttccttcagtacgagatcttctagataccgcctcagctctgtatcgggaagccttagagtctcctgagcattgttcacctcaccatactgcactcaggcaagcaattctttgctggggggaactaatgactctagctacctgggtgggtgttaatttggaagatccagcatctagagacctagtagtcagttatgtcaacactaatatgggcctaaagttcaggcaactcttgtggtttcacatttcttgtctcacttttggaagagaaaccgttatagagtatttggtgtctttcggagtgtggattcgcactcctccagcttatagaccaccaaatgcccctatcctatcaacacttccggaaactactgttgttagacgacgaggcaggtcccctagaagaagaactccctcgcctcgcagacgaaggtctcaatcgccgcgtcgcagaagatctcaatctcgggaacctcaatgttagtattccttggactcataaggtggggaactttactggtctttattcttctactgtacctgtctttaatcctcattggaaaacaccatcttttcctaatatacatttacaccaagacattatcaaaaaatgtgaacagtttgtaggcccacttacagttaatgagaaaagaagattgcaattgattatgcctgctaggttttatccaaaggttaccaaatatttaccattggataagggtattaaaccttattatccagaacatctagttaatcattacttccaaactagacactatttacacactctatggaaggcgggtatattatataagagagaaacaacacatagcgcctcattttgtgggtcaccatattcttgggaacaagatctacagcatggggcagaatctttccaccagcaatcctctgggattctttcccgaccaccagttggatccagccttcagagcaaacacagcaaatccagattgggacttcaatcccaacaaggacacctggccagacgccaacaaggtaggagctggagcattcgggctgggtttcaccccaccgcacggaggccttttggggtggagccctcaggctcagggcatactacaaactttgccagcaaatccgcctcctgcctccaccaatcgccagacaggaaggcagcctaccccgctgtctccacctttgagaaacactcatcctcaggccatgcagtgg

SEQ ID NO: 651 - protein, 543 aa, Synthetic construct
  REGION 1..543: note = DNMT3A/L (AA)
NHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPL

SEQ ID NO: 652 - DNA, 255 bp, Synthetic construct
  misc_feature 1..255: note = N term Npu Intein (nt)
  source 1..255: mol_type = other DNA
tgcctgtcctacgagacagagatcctgacagtggagtatggcctgctgccaatcggcaagatcgtggagaagaggatcgagtgtaccgtgtactctgtggataacaatggcaacatctatacacagcccgtggcacagtggcacgataggggagagcaggaggtgttcgagtattgcctggaggacggcagcctgatcagggcaaccaaggaccacaagttcatgacagtggatggccagatgctgcccatcgac

SEQ ID NO: 653 - protein, 85 aa, Synthetic construct
  REGION 1..85: note = N term Npu Intein (aa)
CLSYETEILTVEYGLLPIGKIVEKRIECTVYSVDNNGNIYTQPVAQWHDRGEQEVFEYCLEDGSLIRATKDHKFMTVDGQMLPID

SEQ ID NO: 654 - DNA, 105 bp, Synthetic construct
  misc_feature 1..105: note = C term Npu Intein (nt)
  source 1..105: mol_type = other DNA
atcaagattgctacacggaaatacctgggaaagcagaacgtgtacgacatcggcgtggagcgggatcacaacttcgccctgaagaatggctttatcgccagcaat

SEQ ID NO: 655 - protein, 35 aa, Synthetic construct
  REGION 1..35: note = C term Npu Intein (aa)
IKIATRKYLGKQNVYDIGVERDHNFALKNGFIASN

SEQ ID NO: 656 - DNA, 2598 bp, Synthetic construct
  misc_feature 1..2598: note = dSpCas9-573-C Intein (nt)
  source 1..2598: mol_type = other DNA
atgaaacggacagccgacggaagcgagttcgagtcaccaaagaagaagcggaaagtcatcaagattgctacacggaaatacctgggaaagcagaacgtgtacgacatcggcgtggagcgggatcacaacttcgccctgaagaatggctttatcgccagcaattgtttcgactctgttgaaatcagcggagtggaggatcgcttcaacgcatccctgggaacgtatcacgatctcctgaaaatcattaaagacaaggacttcctggacaatgaggagaacgaggacattcttgaggacattgtcctcacccttacgttgtttgaagatagggagatgattgaagaacgcttgaaaacttacgctcatctcttcgacgacaaagtcatgaaacagctcaagaggcgccgatatacaggatgggggcggctgtcaagaaaactgatcaatgggatccgagacaagcagagtggaaagacaatcctggattttcttaagtccgatggatttgccaaccggaacttcatgcagttgatccatgatgactctctcacctttaaggaggacatccagaaagcacaagtttctggccagggggacagtcttcacgagcacatcgctaatcttgcaggtagcccagctatcaaaaagggaatactgcagaccgttaaggtcgtggatgaactcgtcaaagtaatgggaaggcataagcccgagaatatcgttatcgagatggcccgagagaaccaaactacccagaagggacagaagaacagtagggaaaggatgaagaggattgaagagggtataaaagaactggggtcccaaatccttaaggaacacccagttgaaaacacccagcttcagaatgagaagctctacctgtactacctgcagaacggcagggacatgtacgtggatcaggaactggacatcaatcggctctccgactacgacgtggatgccatcgtgccccagtcttttctcaaagatgattctattgataataaagtgttgacaagatccgataaaaatagagggaagagtgataacgtcccctcagaagaagttgtcaagaaaatgaaaaattattggcggcagctgctgaacgccaaactgatcacacaacggaagttcgataatctgactaaggctgaacgaggtggcctgtctgagttggataaagccggcttcatcaaaaggcagcttgttgagacacgccagatcaccaagcacgtggcccaaattctcgattcacgcatgaacaccaagtacgatgaaaatgacaaactgattcgagaggtgaaagttattactctgaagtctaagctggtctcagatttcagaaaggactttcagttttataaggtgagagagatcaacaattaccaccatgcgcatgatgcctacctgaatgcagtggtaggcactgcacttatcaaaaaatatcccaagcttgaatctgaatttgtttacggagactataaagtgtacgatgttaggaaaatgatcgcaaagtctgagcaggaaataggcaaggccaccgctaagtacttcttttacagcaatattatgaattttttcaagaccgagattacactggccaatggagagattcggaagcgaccacttatcgaaacaaacggagaaacaggagaaatcgtgtgggacaagggtagggatttcgcgacagtccggaaggtcctgtccatgccgcaggtgaacatcgttaaaaagaccgaagtacagaccggaggcttctccaaggaaagtatcctcccgaaaaggaacagcgacaagctgatcgcacgcaaaaaagattgggaccccaagaaatacggcggattcgattctcctacagtcgcttacagtgtactggttgtggccaaagtggagaaagggaagtctaaaaaactcaaaagcgtcaaggaactgctgggcatcacaatcatggagcgatcaagcttcgaaaaaaaccccatcgactttctcgaggcgaaaggatataaagaggtcaaaaaagacctcatcattaagcttcccaagtactctctctttgagcttgaaaacggccggaaacgaatgctcgctagtgcgggcgagctgcagaaaggtaacgagctggcactgccctctaaatacgttaatttcttgtatctggccagccactatgaaaagctcaaagggtctcccgaagataatgagcagaagcagctgttcgtggaacaacacaaacactaccttgatgagatcatcgagcaaataagcgaattctccaaaagagtgatcctcgccgacgctaacctcgataaggtgctttctgcttacaataagcacagggataagcccatcagggagcaggcagaaaacattatccacttgtttactctgaccaacttgggcgcgcctgcagccttcaagtacttcgacaccaccatagacagaaagcggtacacctctacaaaggaggtcctggacgccacactgattcatcagtcaattacggggctctatgaaacaagaatcgacctctctcagctcggtggagacaaaaggccggcggccacgaaaaaggccggccaggcaaaaaagaaaaagtga

SEQ ID NO: 657 - protein, 865 aa, Synthetic construct
  REGION 1..865: note = dSpCas9-573-C Intein (aa)
MKRTADGSEFESPKKKRKVIKIATRKYLGKQNVYDIGVERDHNFALKNGFIASNCFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPAATKKAGQAKKKK

SEQ ID NO: 658 - protein, 16 aa, Synthetic construct
  REGION 1..16: note = Linker (aa)
SGSETPGTSESATPES

SEQ ID NO: 659 - DNA, 1158 bp, Synthetic construct
  misc_feature 1..1158: note = DNMT3L (nt)
  source 1..1158: mol_type = other DNA
atggcggccatcccagccctggacccagaggccgagcccagcatggacgtgattttggtgggatccagtgagctctcaagctccgtttcacccgggacaggcagagatcttattgcatatgaagtcaaggctaaccagcgaaatatagaagacatctgcatctgctgcggaagtctccaggttcacacacagcaccctctgtttgagggagggatctgcgccccatgtaaggacaagttcctggatgccctcttcctgtacgacgatgacgggtaccaatcctactgctccatctgctgctccggagaaacgctgctcatctgcggaaaccctgattgcacccgatgctactgcttcgagtgtgtggatagcctggtcggccccgggacctcggggaaggtgcacgccatgagcaactgggtgtgctacctgtgcctgccgtcctcccgaagcgggctgctgcagcgtcggaggaagtggcgcagccagctcaaggccttctacgaccgagagtcggagaatccccttgagatgttcgaaaccgtgcctgtgtggaggagacagccagtccgggtgctgtccctttttgaagacatcaagaaagagctgacgagtttgggctttttggaaagtggttctgacccgggacaactgaagcatgtggttgatgtcacagacacagtgaggaaggatgtggaggagtggggacccttcgatcttgtgtacggcgccacacctcccctgggccacacctgtgaccgtcctcccagctggtacctgttccagttccaccggctcctgcagtacgcacggcccaagccaggcagccccaggcccttcttctggatgttcgtggacaatctggtgctgaacaaggaagacctggacgtcgcatctcgcttcctggagatggagccagtcaccatcccagatgtccacggcggatccttgcagaatgctgtccgcgtgtggagcaacatcccagccataaggagcaggcactgggctctggtttcggaagaagaattgtccctgctggcccagaacaagcagagctcgaagctcgcggccaagtggcccaccaagctggtgaagaactgctttctccccctaagagaatatttcaagtatttttcaacagaactcacttcctcttta

SEQ ID NO: 660 - DNA, 966 bp, Synthetic construct
  misc_feature 1..966: note = DNMT3A (nt)
  source 1..966: mol_type = other DNA
acctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtatccaacatgagccgcttggcgaggcagagactgctgggccggtcatggagcgtgccagtcatccgccacctcttcgctccgctgaaggagtattttgcgtgtgtg

SEQ ID NO: 661 - protein, 322 aa, Synthetic construct
  REGION 1..322: note = DNMT3A (AA)
TYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 662 - DNA, 1629 bp, Synthetic construct
  misc_feature 1..1629: note = DNMT3A/L v1 (nt)
  source 1..1629: mol_type = other DNA
aaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctctt

SEQ ID NO: 663 - DNA, 1629 bp, Synthetic construct
  misc_feature 1..1629: note = DNMT3A/L v2 (nt)
  source 1..1629: mol_type = other DNA
aaccacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactg

SEQ ID NO: 664 - protein, 215 aa, Synthetic construct
  REGION 1..215: note = Murine DNMT3L
MGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPL

SEQ ID NO: 665 - protein, 301 aa, Homo sapiens
  REGION 1..301: note = Human DNMT3A
NHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 666 - protein, 213 aa, Homo sapiens
  REGION 1..213: note = C-terminal human DNM3L
NPLEMFETVPVWRRQPVRVLSLFEDIKKELTSLGFLESGSDPGQLKHVVDVTDTVRKDVEEWGPFDLVYGATPPLGHTCDRPPSWYLFQFHRLLQYARPKPGSPRPFFWMFVDNLVLNKEDLDVASRFLEMEPVTIPDVHGGSLQNAVRVWSNIPAIRSRHWALVSEEELSLLAQNKQSSKLAAKWPTKLVKNCFLPLREYFKYFSTELTSSL

SEQ ID NO: 667 - protein, 27 aa, Synthetic construct
  REGION 1..27: note = Linker
SSGNSNANSRGPSFSSGLVPLSLRGSH

SEQ ID NO: 668 - protein, 421 aa, Synthetic construct
  REGION 1..421: note = Murine DNMT3L
MGSRETPSSCSKTLETLDLETSDSSSPDADSPLEEQWLKSSPALKEDSVDVVLEDCKEPLSPSSPPTGREMIRYEVKVNRRSIEDICLCCGTLQVYTRHPLFEGGLCAPCKDKFLESLFLYDDDGHQSYCTICCSGGTLFICESPDCTRCYCFECVDILVGPGTSERINAMACWVCFLCLPFSRSGLLQRRKRWRHQLKAFHDQEGAGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPL

SEQ ID NO: 669 - protein, 87 aa, Synthetic construct
  REGION 1..87: note = KRAB
RTLVTFKDVFVDFTREEWKLLDTAQQILYRNVMLENYKNLVSLGYQLTKPDVILRLEKGEEPWLVEREIHQETHPDSETAFEIKSSV

SEQ ID NO: 670 - protein, 15 aa, Synthetic construct
  REGION 1..15: note = NLS and linker
PKKKRKVGIHGVPAA

SEQ ID NO: 671 - protein, 8 aa, Synthetic construct
  REGION 1..8: note = Flag tag
DYKDDDDK

SEQ ID NO: 672 - protein, 17 aa, Synthetic construct
  REGION 1..17: note = Linker
EASGSGRASPGIPGSTR

SEQ ID NO: 673 - protein, 8 aa, Synthetic construct
  REGION 1..8: note = Linker
GIHGVPAA

SEQ ID NO: 674 - protein, 23 aa, Synthetic construct
  REGION 1..23: note = 3 x Flag peptide
MDYKDHDGDYKDHDIDYKDDDDK

SEQ ID NO: 675 - protein, 9 aa, Synthetic construct
  REGION 1..9: note = HA tag
YPYDVPDYA

SEQ ID NO: 676 - protein, 6 aa, Synthetic construct
  REGION 1..6: note = poly-histidine tag
HHHHHH

SEQ ID NO: 677 - protein, 27 aa, Synthetic construct
  REGION 1..27: note = Linker
KRPAATKKAGQAKKKKASDAKSLTAWS

SEQ ID NO: 678 - DNA, 3222 bp, Synthetic construct
  misc_feature 1..3222: note = Hep3B Consensus sequence (3222bp)
  misc_feature 1: note = n = A,T,C or G
  misc_feature 2100..2293: note = n = A,T,C or G
  source 1..3222: mol_type = other DNA
ntccacagccttccaccaagctctgcaggatcccagagtcaggggtctgtattttcctgctggtggctccagttcaggaacagtaaaccctgctccgaatattgcctctcacatctcgtcaatctccgcgaggactggggaccctgtgacgaacatggagaacatcacatcaggattcctaggacccctgctcgtgttacaggcggggtttttctcgttgacaagaatcctcacaataccgcagagtctagactcgtggtggacttctctcagttttctagggggtccacccgtgtgtcttggccaaaattcgcagtccccaacctccaatcactcaccaacctcctgtcctccaatctgtcctggttatcgctggatgtgtctgcggcgttttatcatattcctcttcatcctgctgctatgcctcatcttcttattggttcttctggattatcaaggtatgttgcccgtttgtcctctaattccaggatcaacaacaaccagtacgggaccatgcaaaacctgcacgactcctgctcaaggcaactctatgtttccctcatgttgctgtacaaaacctacggatggaaattgcacctgtattcccatcccatcgtcttgggctttcgcaaaatacctatgggagtgggcctcagtccgtttctcttggctcagtttactagtgccatttgttcagtggttcgtagggctttcccccactgtttggctttcagctatatggatgatgtggtattgggggccaagactgtacagcatcgtgagtccctttataccgctgttaccaattttcttttgtctctgggtatacatttaaaccctaacaaaacaaaaagatggggttattccctaaacttcatgggttacgtaattggaagttgggggacattgccacaagatcatattgtacaaaagatcaaacactgttttagaaaacttcctgtaaacaggcctattgattggaaagtatgtcaaaggattgtgggtcttttgggctttgctgctccatttacacaatgtggatatcctgccttaatgcctttgtatgcatgtatacaagctaaacaggctttcactttctcgccaacttacaaggcctttctaagtaaacagtacctgaacctttaccccgttgctcggcaacggccaggtctgtgccaagtgtttgctgacgcaacccccactggctggggcttagccataggccatcagcgcatgcgtggaacctttgtggctcctctgccgatccatactgcggaactcctagccgcttgttttgctcgcagccggtctggagcaaagctcatcggaactgacaattctgtcgtcctctcgcggaaatatacatcgtttccatggctgctaggctgtactgccaactggatccttcgcgggacgtcctttgtttacgtcccgtcggcgctgaatcccgcggacgacccctctcggggccgcttgggactctctcgtccccttctccgtctgccgttccagccgaccacggggcgcacctctctttacgcggtctccccgtctgtgccttctcatctgccggtccgtgtgcacttcgcttcacctctgcacgttgcatggagaccaccgtgaacgcccatcagagcctgcccaaggtcttacataagaggactcttggactcccagcaatgtcaacgaccgaccttgaggcctacttcaaagactgtgtgtttaaggactgggaggagctgggggaggagattaggttaatgatctttgtattaggaggctgtaggcatgagccttttatgcctaagaatgtgtctgtctcataatgcaagtggtcaatccagccagcaccatgcgaactttttcacctctgcctaatcatctcttgtacatgtcccactgttcaagcctccaagctgtgccttgggtggctttggggcatggacattgacccttataaagaatttggagctactgtggagttactctcgtttttgccttctgacttttttccttccgtcagagatctcctagacaccgcctcagctctgtatcgggaagccttagagtctcctgagcattgctctcctcaccatactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctctgggattctttcccgatcatcagttggaccnnnnnnnnnnnnnnnnnnnnnnnaatccagattgggacttcaaccccatcaaggaccactggccagcagccaaccaggtaggagtgggagcattcgggccagggttcacccctccacacggcggtgttttggggtggagccctcaggctcagggcatactacaaactgtgtcaacaattcctcctcctgcctccaccaatcggcagtcaggaaggcagcctactcccatctctccacctctaaaagacagtcatcctcaggccacgcagtggaa

SEQ ID NO: 679 - DNA, 3213 bp, Synthetic construct
  misc_feature 1..3213: note = PLC/PRF/5 Cells (Alexander Cells) Consensus Genome: LC533934.1 (3213 bp)
  source 1..3213: mol_type = other DNA
ttccacagccttccaccaagctctgcaagatcccagagtcaggggcctgtattttcctgctggtggctccagttcaggaacagtaaaccctgctcagaatattgcctctcacatctcgtcaatctcctcgaggactggggaccctgcaccgaacatggagaacattacatcaggattcctaggacccctgctcgtgttacaggcggggtttttcttgttgacaagaatcctcacaataccacagagtctagactcgtggtggacttctctcaattttctagggggatcacccgtgtgtcttggccaaaattcgcagtccccaacctccaatcactcaccaacctcctgtcctccaatttgtcctggttatcgctggatgtgtctgcggcgttttatcatattcctcttcatcctgctgctatgcctcatcttcttattggttcttctggactatcaaggtatgttgcccgtttgtcctctaattccaggatccacaacaaccagtacgggaccctgcaaaacctgcacgactcctgctcaaggcaactctatgtttccctcatgttgctgtacaaaacctacggatggaaattgcacctgtattcccatcccatcatcttgggctttcgcaaaatacctatgggagtggggctcagtccgtttctcttggctcagtttactagtgccatttgttcagtggttcgtagggctttcccccactgtttggctttcagttatatggatgatgtggtattgggggccaaatctgtacaacatcttgagtccctttataccgctgttaccaattttcttttgtctttgggtatacatttaaaccctaacaaaacgaagagatggggttattccctaaacttcatgggatatgtaattggaagttggggtaccttgccacaggatcatattgtacaaaaaatcaaacgctgttttaggaaacttcctgtcaatcgacctattgattggaaagtatgtcaaagaattgtgggtcttttgggctttgccgcgccctttacacaatgtggttaccctgccttaatgcctttatatgcatgtatacaagcaaaacaggcttttactttctcgccaacttacaaggcctttctaagtaaacagtatatgaacctttaccccgttgcccggcaacggcctggcctgtgccaagtgtttgctgacgcaacccccactggctggggcttggctatgggccatcagcgcatgcgtggaacctttgtggctcctctgccgatccatactgcggaacttcttgcagcttgttttgctcgcagccggtctggagcgaaactcatcgggactgataattctgtcgtcctttctcggaaatatacatcatttccatggctgctaggttgtgctgctaactggattcttcgcgggacgtcctttgtctacgtcccgtcggcgctgaatcctgcggacgacccctcccggggccgcttgggactctatcgtccccttcttcgtctgccgtaccgtccgaccacggggcgcacctctctttacgcggtctccccgtctgtgccttctcatctgccggtccgtgtgcacttcgcttcacctctgcacgttgcatggagaccaccgtgaacgcccatcggatcctgcccaaggtcttacataagaggactcttggactcccagcaatgtcaacgaccgaccttgaggcttacttcaaagactgtgtgtttaaagactgggaggagttgggggaggagattaggttaaatattaggaggctgtaggcataaattggtctgcgcaccatcatcatgcaactttttcacctctgcctattcatctctcgttcatgtcctactgttcaagcctccaagctgtgccttgggtggctttagggcatggacattgacccttataaagaatttggagctactgtggagttactctcgtttttgccttctgacttctttccttcggtccgagatctcctagacaccgcctcagctctatatcgggaagccttagagtctcctgagcattgttcccctcatcatacagcactcaggcaagcaattctttgctggggggaattaatgactctagctacctgggtgggtaataatttggaagatccagcatccagggatctagtagtcaattatgtgaatactaacatgggcctaaagatcagacaactattgtggtttcatatttcttgccttacttttggaagagaaacagtgcttgagtatttggtctccttcggagtgtggattcgcactcctccagcctatagaccaccaaatgcccctatcttatcaacacttccggaaactactgttgttagacgacgagaccgaggcaggtcccctagaagaagaactccctcgcctcgcagacgaagatctcaatcgccgcgtcgcagaagatctcaatctcgggaatctcaatgttagtattccttggactcataaggtgggaaattttactgggctttattcctctactgtccctatctttaatcctgaatggcaaacgccttcctttcctaaaatccatttacacgaggacattattaataggtgtcagcaatttgtaggccctctcactgtaaatgaaaagagaagattgaacttaattatgcctgctaggttttatcctaactccactaaatatttgcctctagacaaaggaattaagccttattatcctgaacatgtagttaatcattacttccagacccgacattatttacatactctttggaaggctgggattctatataagagggaaactacacgtagcgcctcattttgcgggtcaccatattcttgggaacaagagctacatcatgggaggttggttaccaaaacctcgcaaaggcatggggacgaatctgtctgtccccaaccctctgggattctttcccgatcatcagttggacccagcattcggagccaattcaaacaatccagactgggacttcaaccccacaaaggaccactggccacaagccaaccaggtaggagtgggagcattcggcccagggttcacccctccacacggaggtcttttggggtggagctctcaggctcaaggcacattgcatactgtgccagcagtgcctcctcctgcctccaccaatcggcagtcaggaaggcagcctactcccatctctccacctctaagagacagtcatcctcaggccatgcagtggaa

SEQ ID NO: 680 - RNA, 6433 nt, synthetic construct
  source 1..6433: mol_type = other RNA
  misc_feature 1..6433: note = pTT0728_HBVg_mRNA_1
ggagcaattgaccgggaagctcagaataaacgctcaactttggccggatcttctagagccaccatgaaccacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctcaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaaaagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactggaggcaagcggatccggaagggcatctcctggaatcccaggaagcacccgcaaccccaagaagaagcggaaggtgggcatccacggcgtgcccgccgccgacaagaagtacagcatcggcctggccatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaaaagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaaaagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggacgccatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaaaagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaaaagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgacagcggcggcaagcggcccgccgccaccaagaaggccggccaggccaagaagaagaaggctagcgatgctaagtcactgactgcctggtcccggacactggtgaccttcaaggatgtgtttgtggacttcaccagggaggagtggaagctgctggacactgctcagcagatcctgtacagaaatgtgatgctggagaactataagaacctggtttccttgggttatcagcttactaagccagatgtgatcctccggttggagaagggagaggaaccctggctggtggagagagaaattcaccaagagacccatcctgattcagagactgcatttgaaatcaaatcatcagttccgaaaaagaaacgcaaagtttagtaagaattcaaagaaagtttcttcacattctctcgagcgtacgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 681 - RNA, 63 nt, Synthetic construct
  misc_feature 1..63: note = 5' UTR (5U4)
  source 1..63: mol_type = other RNA
ggagcaattgaccgggaagctcagaataaacgctcaactttggccggatcttctagagccacc

SEQ ID NO: 682 - RNA, 46 nt, Synthetic construct
  misc_feature 1..46: note = 3' UTR (3U2)
  source 1..46: mol_type = other RNA
tagtaagaattcaaagaaagtttcttcacattctctcgagcgtacg

SEQ ID NO: 683 - protein, 87 aa, Synthetic construct; identical to SEQ ID NO: 669
  REGION 1..87: note = KRAB

SEQ ID NO: 684 - protein, 15 aa, Synthetic construct
  REGION 1..15: note = NLS and linker
PKKKRKVGIHGVPAA

SEQ ID NO: 685 - protein, 8 aa, Synthetic construct
  REGION 1..8: note = Flag tag
DYKDDDDK

SEQ ID NO: 686 - protein, 17 aa, Synthetic construct
  REGION 1..17: note = Linker
EASGSGRASPGIPGSTR

SEQ ID NO: 687 - protein, 8 aa, Synthetic construct
  REGION 1..8: note = Linker
GIHGVPAA

SEQ ID NO: 688 - protein, 23 aa, Synthetic construct
  REGION 1..23: note = 3 x Flag peptide
MDYKDHDGDYKDHDIDYKDDDDK

SEQ ID NO: 689 - protein, 9 aa, Synthetic construct
  REGION 1..9: note = HA tag
YPYDVPDYA

SEQ ID NO: 690 - protein, 6 aa, Synthetic construct
  REGION 1..6: note = poly-histidine tag
HHHHHH

SEQ ID NO: 691 - protein, 27 aa, Synthetic construct
  REGION 1..27: note = Linker
KRPAATKKAGQAKKKKASDAKSLTAWS

SEQ ID NO: 692 - protein, 180 aa, Synthetic construct
  REGION 1..180: note = ZFP AA sequence
AAMAERPFQCRICMRNFSSEADRSRHIRTHTGEKPFACDICGRKFADRSNLTRHTKIHTGSQKPFQCRICMRNFSQSSDLSRHIRTHTGEKPFACDICGRKFAYHWYLKKHTKIHTGSQKPFQCRICMRNFSRSDSLSVHIRTHTGEKPFACDICGRKFAQNANRKTHTKIHLRQKDAAR

SEQ ID NO: 693 - protein, 180 aa, Synthetic construct
  REGION 1..180: note = ZFP AA sequence
AAMAERPFQCRICMRNFSRSDVLSTHIRTHTGEKPFACDICGKKFADNSSRTRHTKIHTGSQKPFQCRICMRNFSRPYTLRLHIRTHTGEKPFACDICGRKFADSSHRTRHTKIHTGSQKPFQCRICMRNFSRSDHLSQHIRTHTGEKPFACDICGRKFADSSHRTRHTKIHLRQKDAAR

SEQ ID NO: 694 - protein, 180 aa, Synthetic construct
  REGION 1..180: note = ZFP AA sequence
AAMAERPFQCRICMRNFSRSDHLSQHIRTHTGEKPFACDICGRKFAQSADRTKHTKIHTGSQKPFQCRICMRNFSRSDHLSQHIRTHTGEKPFACDICGRKFARRSDLKRHTKIHTGSQKPFQCRICMRNFSRSDHLSRHIRTHTGEKPFACDICGRKFAQSSDLRRHTKIHLRQKDAAR

SEQ ID NO: 695 - protein, 180 aa, Synthetic construct
  REGION 1..180: note = ZFP AA sequence
AAMAERPFQCRICMRNFSRSDNLSEHIRTHTGEKPFACDICGRKFATSSNRKTHTKIHTGSQKPFQCRICMRNFSDRSHLTRHIRTHTGEKPFACDICGRKFARSDALTQHTKIHTGSQKPFQCRICMRNFSDRSALARHIRTHTGEKPFACDICGRKFARRFTLSKHTKIHLRQKDAAR

SEQ ID NO: 696 - protein, 180 aa, Synthetic construct
  REGION 1..180: note = ZFP AA sequence
AAMAERPFQCRICMRNFSRSDHLSEHIRTHTGEKPFACDICGRKFAQYSGRYYHTKIHTGSQKPFQCRICMRNFSHGQTLNEHIRTHTGEKPFACDICGRKFAQSGNLARHTKIHTGSQKPFQCRICMRNFSRSDSLLRHIRTHTGEKPFACDICGRKFACREYRGKHTKIHLRQKDAAR

SEQ ID NO: 697 - protein, 180 aa, Synthetic construct
  REGION 1..180: note = ZFP AA sequence
AAMAERPFQCRICMRNFSQSANRTTHIRTHTGEKPFACDICGRKFARSANLTRHTKIHTGSQKPFQCRICMRNFSRSDVLSEHIRTHTGEKPFACDICGRKFATSGHLSRHTKIHTGSQKPFQCRICMRNFSQSSDLSRHIRTHTGEKPFACDICGRKFAQWSTRKRHTKIHLRQKDAAR

SEQ ID NO: 698 - protein, 180 aa, Synthetic construct
  REGION 1..180: note = ZFP AA sequence
AAMAERPFQCRICMRNFSQSGNLARHIRTHTGEKPFACDICGRKFAATCCLAHHTKIHTGSQKPFQCRICMRNFSRWQYLPTHIRTHAGEKPFACDICGRKFADRSALARHTKIHTGSQKPFQCRICMRNFSRSDNLSEHIRTHTGEKPFACDICGRKFAKRCNLRCHTKIHLRQKDAAR

SEQ ID NO: 699 - protein, 180 aa, Synthetic construct
  REGION 1..180: note = ZFP AA sequence
AAMAERPFQCRICMRNFSNPANLTRHIRTHTGEKPFACDICGRKFAQNATRTKHTKIHTGSQKPFQCRICMRNFSQSGHLARHIRTHTGEKPFACDICGRKFANRHDRAKHTKIHTGSQKPFQCRICMRNFSRSDHLSEHIRTHTGEKPFACDICGRKFAQRRSRYKHTKIHLRQKDAAR

SEQ ID NO: 700 - protein, 180 aa, Synthetic construct
  REGION 1..180: note = ZFP AA sequence
AAMAERPFQCRICMRNFSQSSDLSRHIRTHTGEKPFACDICGRKFAHRSTRNRHTKIHTGSQKPFQCRICMRNFSRSDVLSAHIRTHTGEKPFACDICGRKFADSRTRKNHTKIHTGSQKPFQCRICMRNFSQSGSLTRHIRTHTGEKPFACDICGRKFADQSGLAHHTKIHLRQKDAAR

SEQ ID NO: 701 - protein, 180 aa, Synthetic construct
  REGION 1..180: note = ZFP AA sequence
AAMAERPFQCRICMRNFSQNPAQWRHIRTHTGEKPFACDICGRKFARSADLSRHTKIHTGSQKPFQCRICMRNFSTSGSLSRHIRTHTGEKPFACDICGRKFARSDHLSRHTKIHTGSQKPFQCRICMRNFSRSDSLLRHIRTHTGEKPFACDICGRKFAQSYDRFQHTKIHLRQKDAAR

SEQ ID NO: 702 - protein, 180 aa, Synthetic construct
  REGION 1..180: note = ZFP AA sequence
AAMAERPFQCRICMRNFSTSGSLSRHIRTHTGEKPFACDICGRKFARSDHLSRHTKIHTGSQKPFQCRICMRNFSRSDSLLRHIRTHTGEKPFACDICGRKFAQSYDRFQHTKIHTGSQKPFQCRICMRNFSRSDNLSTHIRTHTGEKPFACDICGRKFADNRDRIKHTKIHLRQKDAAR

SEQ ID NO: 703 - protein, 180 aa, Synthetic construct
  REGION 1..180: note = ZFP AA sequence
AAMAERPFQCRICMRNFSDRSNLSRHIRTHTGEKPFACDICGRKFALRQNLIMHTKIHTGSQKPFQCRICMRNFSERGTLARHIRTHTGEKPFACDICGRKFARSDALTQHTKIHTGSQKPFQCRICMRNFSRSDSLSQHIRTHTGEKPFACDICGRKFARKADRTRHTKIHLRQKDAAR

SEQ ID NO: 704 - protein, 180 aa, Synthetic construct
  REGION 1..180: note = ZFP AA sequence
AAMAERPFQCRICMRNFSQYCCLTNHIRTHTGEKPFACDICGRKFATSGNLTRHTKIHTGSQKPFQCRICMRNFSQSSDLSRHIRTHTGEKPFACDICGRKFAFRYYLKRHTKIHTGSQKPFQCRICMRNFSQSGDLTRHIRTHTGEKPFACDICGRKFADKGNLTKHTKIHLRQKDAAR

SEQ ID NO: 705 - protein, 180 aa, Synthetic construct
  REGION 1..180: note = ZFP AA sequence
AAMAERPFQCRICMRNFSTSGSLSRHIRTHTGEKPFACDICGRKFARSDNLTTHTKIHTGSQKPFQCRICMRNFSQSGNLARHIRTHTGEKPFACDICGRKFADRTTLMRHTKIHTGSQKPFQCRICMRNFSQSGHLARHIRTHTGEKPFACDICGRKFAQLTHLNSHTKIHLRQKDAAR

SEQ ID NO: 706 - protein, 180 aa, Synthetic construct
  REGION 1..180: note = ZFP AA sequence
AAMAERPFQCRICMRNFSIKHDLHRHIRTHTGEKPFACDICGRKFARSANLTRHTKIHTGSQKPFQCRICMRNFSRSDNLARHIRTHTGEKPFACDICGRKFAQNVSRPRHTKIHTGSQKPFQCRICMRNFSRSDDLSKHIRTHTGEKPFACDICGRKFADSSHRTRHTKIHLRQKDAAR

SEQ ID NO: 707 - protein, 180 aa, Synthetic construct
  REGION 1..180: note = ZFP AA sequence
AAMAERPFQCRICMRNFSRSDNLARHIRTHTGEKPFACDICGRKFAQNVSRPRHTKIHTGSQKPFQCRICMRNFSRSDDLSKHIRTHTGEKPFACDICGRKFADSSHRTRHTKIHTGSQKPFQCRICMRNFSTSSNRKTHIRTHTGEKPFACDICGRKFAAQWTRACHTKIHLRQKDAAR

SEQ ID NO: 708 - protein, 180 aa, Synthetic construct
  REGION 1..180: note = ZFP AA sequence
AAMAERPFQCRICMRNFSRSDDLSKHIRTHTGEKPFACDICGRKFADSSHRTRHTKIHTGSQKPFQCRICMRNFSTSSNRKTHIRTHTGEKPFACDICGRKFAAQWTRACHTKIHTGSQKPFQCRICMRNFSRKQTRTTHIRTHTGEKPFACDICGRKFAHRSSLRRHTKIHLRQKDAAR

SEQ ID NO: 709 - protein, 180 aa, Synthetic construct
  REGION 1..180: note = ZFP AA sequence
AAMAERPFQCRICMRNFSQSAHRKNHIRTHTGEKPFACDICGRKFATSSNRKTHTKIHTGSQKPFQCRICMRNFSRSDNLSAHIRTHTGEKPFACDICGRKFARNNDRKTHTKIHTGSQKPFQCRICMRNFSTSGSLSRHIRTHTGEKPFACDICGRKFAQAGHLAKHTKIHLRQKDAAR

SEQ ID NO: 710 - protein, 180 aa, Synthetic construct
  REGION 1..180: note = ZFP AA sequence
AAMAERPFQCRICMRNFSRSDHLSQHIRTHTGEKPFACDICGRKFAASSTRTKHTKIHTGSQKPFQCRICMRNFSRSDDLTRHIRTHTGEKPFACDICGRKFAQKSNLSSHTKIHTGSQKPFQCRICMRNFSQSANRTTHIRTHTGEKPFACDICGRKFAQNATRTKHTKIHLRQKDAAR

SEQ ID NO: 711 - protein, 180 aa, Synthetic construct
  REGION 1..180: note = ZFP AA sequence
AAMAERPFQCRICMRNFSRSDTLSEHIRTHTGEKPFACDICGRKFARRWTLVGHTKIHTGSQKPFQCRICMRNFSDRSNLSRHIRTHTGEKPFACDICGRKFAQSGDLTRHTKIHTGSQKPFQCRICMRNFSQSSDLSRHIRTHTGEKPFACDICGRKFAYHWYLKKHTKIHLRQKDAAR

SEQ ID NO: 712 - protein, 180 aa, Synthetic construct
  REGION 1..180: note = ZFP AA sequence
AAMAERPFQCRICMRNFSRSANLARHIRTHTGEKPFACDICGRKFARSDNLREHTKIHTGSQKPFQCRICMRNFSRPYTLRLHIRTHTGEKPFACDICGRKFAHRSNLNKHTKIHTGSQKPFQCRICMRNFSQSGSLTRHIRTHTGEKPFACDICGRKFATSANLSRHTKIHLRQKDAAR

SEQ ID NO: 713 - protein, 176 aa, Synthetic construct
  REGION 1..176: note = ZFP AA sequence
LEPGEKPYACPECGKSFSRSDDLVRHQRTHTGEKPYKCPECGKSFSTSGSLVRHQRTHTGEKPYKCPECGKSFSRSDKLVRHQRTHTGEKPYACPECGKSFSRSDELVRHQRTHTGEKPYKCPECGKSFSTSHSLTEHQRTHTGEKPYKCPECGKSFSRADNLTEHQRTHTGKKTS

SEQ ID NO: 714 - protein, 176 aa, Synthetic construct
  REGION 1..176: note = ZFP AA sequence
LEPGEKPYACPECGKSFSERSHLREHQRTHTGEKPYKCPECGKSFSTSHSLTEHQRTHTGEKPYKCPECGKSFSQAGHLASHQRTHTGEKPYACPECGKSFSTSHSLTEHQRTHTGEKPYKCPECGKSFSDPGHLVRHQRTHTGEKPYKCPECGKSFSTSGNLVRHQRTHTGKKTS

SEQ ID NO: 715 - protein, 176 aa, Synthetic construct
  REGION 1..176: note = ZFP AA sequence
LEPGEKPYKCPECGKSFSRADNLTEHQRTHTGEKPYKCPECGKSFSTSGSLVRHQRTHTGEKPYKCPECGKSFSRKDNLKNHQRTHTGEKPYKCPECGKSFSQSSSLVRHQRTHTGEKPYKCPECGKSFSRSDKLVRHQRTHTGEKPYKCPECGKSFSDSGNLRVHQRTHTGKKTS

SEQ ID NO: 716 - protein, 176 aa, Synthetic construct
  REGION 1..176: note = ZFP AA sequence
LEPGEKPYACPECGKSFSQSSSLVRHQRTHTGEKPYKCPECGKSFSQSGDLRRHQRTHTGEKPYKCPECGKSFSRSDERKRHQRTHTGEKPYACPECGKSFSHRTTLTNHQRTHTGEKPYKCPECGKSFSRSDHLTNHQRTHTGEKPYKCPECGKSFSTSGELVRHQRTHTGKKTS

SEQ ID NO: 717 - protein, 176 aa, Synthetic construct
  REGION 1..176: note = ZFP AA sequence
LEPGEKPYACPECGKSFSQSGDLRRHQRTHTGEKPYKCPECGKSFSRSDERKRHQRTHTGEKPYKCPECGKSFSHRTTLTNHQRTHTGEKPYACPECGKSFSRSDHLTNHQRTHTGEKPYKCPECGKSFSTSGELVRHQRTHTGEKPYKCPECGKSFSRSDDLVRHQRTHTGKKTS

SEQ ID NO: 718 - protein, 176 aa, Synthetic construct
  REGION 1..176: note = ZFP AA sequence
LEPGEKPYACPECGKSFSQRAHLERHQRTHTGEKPYKCPECGKSFSQLAHLRAHQRTHTGEKPYKCPECGKSFSDPGHLVRHQRTHTGEKPYACPECGKSFSRRSACRRHQRTHTGEKPYKCPECGKSFSRSDHLTTHQRTHTGEKPYKCPECGKSFSQSSSLVRHQRTHTGKKTS

SEQ ID NO: 719 - protein, 176 aa, Synthetic construct
  REGION 1..176: note = ZFP AA sequence
LEPGEKPYACPECGKSFSQSSNLVRHQRTHTGEKPYKCPECGKSFSRSDDLVRHQRTHTGEKPYKCPECGKSFSTHLDLIRHQRTHTGEKPYACPECGKSFSTSGNLTEHQRTHTGEKPYKCPECGKSFSRRSACRRHQRTHTGEKPYKCPECGKSFSRNDTLTEHQRTHTGKKTS

SEQ ID NO: 720 - protein, 7 aa, Synthetic construct
  REGION 1..7: note = F1
SEADRSR

SEQ ID NO: 721 - protein, 7 aa, Synthetic construct
  REGION 1..7: note = F2
DRSNLTR

SEQ ID NO: 722 - protein, 7 aa, Synthetic construct
  REGION 1..7: note = F3
QSSDLSR

SEQ ID NO: 723 - protein, 7 aa, Synthetic construct
  REGION 1..7: note = F4
YHWYLKK

SEQ ID NO: 724 - protein, 7 aa, Synthetic construct
  REGION 1..7: note = F5
RSDSLSV

SEQ ID NO: 725 - protein, 7 aa, Synthetic construct
  REGION 1..7: note = F6
QNANRKT

SEQ ID NO: 726 - protein, 7 aa, Synthetic construct
  REGION 1..7: note = F1
RSDVLST

SEQ ID NO: 727 - protein, 7 aa, Synthetic construct
  REGION 1..7: note = F2
DNSSRTR

SEQ ID NO: 728 - protein, 7 aa, Synthetic construct
  REGION 1..7: note = F3
RPYTLRL

SEQ ID NO: 729 - protein, 7 aa, Synthetic construct
  REGION 1..7: note = F4
DSSHRTR

SEQ ID NO: 730 - protein, 7 aa, Synthetic construct
  REGION 1..7: note = F5
RSDHLSQ

SEQ ID NO: 731 - protein, 7 aa, Synthetic construct
  REGION 1..7: note = F6
DSSHRTR

SEQ ID NO: 732 - protein, 7 aa, Synthetic construct
  REGION 1..7: note = F1
RSDHLSQ

SEQ ID NO: 733 - protein, 7 aa, Synthetic construct
  REGION 1..7: note = F2
QSADRTK

SEQ ID NO: 734 - protein, 7 aa, Synthetic construct
  REGION 1..7: note = F3
RSDHLSQ

SEQ ID NO: 735 - protein, 7 aa, Synthetic construct
  REGION 1..7: note = F4
RRSDLKR

SEQ ID NO: 736 - protein, 7 aa, Synthetic construct
  REGION 1..7: note = F5
RSDHLSR

SEQ ID NO: 737 - protein, 7 aa, Synthetic construct
  REGION 1..7: note = F6
QSSDLRR

SEQ ID NO: 738 - protein, 7 aa, Synthetic construct
  REGION 1..7: note = F1
RSDNLSE

SEQ ID NO: 739 - protein, 7 aa, Synthetic construct
  REGION 1..7: note = F2
TSSNRKT

SEQ ID NO: 740 - protein, 7 aa, Synthetic construct
  REGION 1..7: note = F3
DRSHLTR

SEQ ID NO: 741 - protein, 7 aa, Synthetic construct
  REGION 1..7: note = F4
RSDALTQ

SEQ ID NO: 742 - protein, 7 aa, Synthetic construct
  REGION 1..7: note = F5
DRSALAR

SEQ ID NO: 743 - protein, 7 aa, Synthetic construct
  REGION 1..7: note = F6
RRFTLSK

SEQ ID NO: 744 - protein, 7 aa, Synthetic construct
  REGION 1..7: note = F1
RSDHLSE

SEQ ID NO: 745 - protein, 7 aa, Synthetic construct
  REGION 1..7: note = F2
QYSGRYY

SEQ ID NO: 746 - protein, 7 aa, Synthetic construct
  REGION 1..7: note = F3
HGQTLNE

SEQ ID NO: 747 - protein, 7 aa, Synthetic construct
  REGION 1..7: note = F4
QSGNLAR

SEQ ID NO: 748 - protein, 7 aa, Synthetic construct
  REGION 1..7: note = F5
RSDSLLR

SEQ ID NO: 749 - protein, 7 aa, Synthetic construct
  REGION 1..7: note = F6
CREYRGK

SEQ ID NO: 750 - protein, 7 aa, Synthetic construct
  REGION 1..7: note = F1
QSANRTT

SEQ ID NO: 751 - protein, 7 aa, Synthetic construct
  REGION 1..7: note = F2
RSANLTR

SEQ ID NO: 752 - protein, 7 aa, Synthetic construct
  REGION 1..7: note = F3
RSDVLSE

SEQ ID NO: 753 - protein, 7 aa, Synthetic construct
  REGION 1..7: note = F4
TSGHLSR

SEQ ID NO: 754 - protein, 7 aa, Synthetic construct
  REGION 1..7: note = F5
QSSDLSR

SEQ ID NO: 755 - protein, 7 aa, Synthetic construct
  REGION 1..7: note = F6
QWSTRKR

SEQ ID NO: 756 - protein, 7 aa, Synthetic construct
  REGION 1..7: note = F1
QSGNLAR

SEQ ID NO: 757 - protein, 7 aa, Synthetic construct
  REGION 1..7: note = F2
ATCCLAH

SEQ ID NO: 758 - protein, 7 aa, Synthetic construct
  REGION 1..7: note = F3
RWQYLPT

SEQ ID NO: 759 - protein, 7 aa, Synthetic construct
  REGION 1..7: note = F4
DRSALAR

SEQ ID NO: 760 - protein, 7 aa, Synthetic construct
  REGION 1..7: note = F5
RSDNLSE

SEQ ID NO: 761 - protein, 7 aa, Synthetic construct
  REGION 1..7: note = F6
KRCNLRC

SEQ ID NO: 762 - protein, 7 aa, Synthetic construct
  REGION 1..7: note = F1
NPANLTR

SEQ ID NO: 763 - protein, 7 aa, Synthetic construct
  REGION 1..7: note = F2
QNATRTK

SEQ ID NO: 764 - protein, 7 aa, Synthetic construct
  REGION 1..7: note = F3
QSGHLAR

SEQ ID NO: 765 - protein, 7 aa, Synthetic construct
  REGION 1..7: note = F4
NRHDRAK

SEQ ID NO: 766 - protein, 7 aa, Synthetic construct
  REGION 1..7: note = F5
RSDHLSE

SEQ ID NO: 767 - protein, 7 aa, Synthetic construct
  REGION 1..7: note = F6
QRRSRYK

SEQ ID NO: 768 - protein, 7 aa, Synthetic construct
  REGION 1..7: note = F1
QSSDLSR

SEQ ID NO: 769 - protein, 7 aa, Synthetic construct
  REGION 1..7: note = F2
HRSTRNR

SEQ ID NO: 770 - protein, 7 aa, Synthetic construct
  REGION 1..7: note = F3
RSDVLSA

SEQ ID NO: 771 - protein, 7 aa, Synthetic construct
  REGION 1..7: note = F4
DSRTRKN

SEQ ID NO: 772 - protein, 7 aa, Synthetic construct
  REGION 1..7: note = F5
QSGSLTR

SEQ ID NO: 773 - protein, 7 aa, Synthetic construct
  REGION 1..7: note = F6
DQSGLAH

SEQ ID NO: 774 - protein, 7 aa, Synthetic construct
  REGION 1..7: note = F1
QNPAQWR

SEQ ID NO: 775 - protein, 7 aa, Synthetic construct
  REGION 1..7: note = F2
RSADLSR

SEQ ID NO: 776 - protein, 7 aa, Synthetic construct
  REGION 1..7: note = F3
TSGSLSR

SEQ ID NO: 777 - protein, 7 aa, Synthetic construct
  REGION 1..7: note = F4
RSDHLSR

SEQ ID NO: 778 - protein, 7 aa, Synthetic construct
  REGION 1..7: note = F5
RSDSLLR

SEQ ID NO: 779 - protein, 7 aa, Synthetic construct
  REGION 1..7: note = F6
QSYDRFQ

SEQ ID NO: 780 - protein, 7 aa, Synthetic construct
  REGION 1..7: note = F1
TSGSLSR

SEQ ID NO: 781 - protein, 7 aa, Synthetic construct
  REGION 1..7: note = F2
RSDHLSR

SEQ ID NO: 782 - protein, 7 aa, Synthetic construct
  REGION 1..7: note = F3
RSDSLLR

SEQ ID NO: 783 - protein, 7 aa, Synthetic construct
  REGION 1..7: note = F4
QSYDRFQ

SEQ ID NO: 784 - protein, 7 aa, Synthetic construct
  REGION 1..7: note = F5
RSDNLST

SEQ ID NO: 785 - protein, 7 aa, Synthetic construct
  REGION 1..7: note = F6
DNRDRIK

SEQ ID NO: 786 - protein, 7 aa, Synthetic construct
  REGION 1..7: note = F1
DRSNLSR

SEQ ID NO: 787 - protein, 7 aa, Synthetic construct
  REGION 1..7: note = F2
LRQNLIM

SEQ ID NO: 788 - protein, 7 aa, Synthetic construct
  REGION 1..7: note = F3
ERGTLAR

SEQ ID NO: 789 - protein, 7 aa, Synthetic construct
  REGION 1..7: note = F4
RSDALTQ

SEQ ID NO: 790 - protein, 7 aa, Synthetic construct
  REGION 1..7: note = F5
RSDSLSQ

SEQ ID NO: 791 - protein, 7 aa, Synthetic construct
  REGION 1..7: note = F6
RKADRTR

SEQ ID NO: 792 - protein, 7 aa, Synthetic construct
  REGION 1..7: note = F1
QYCCLTN

SEQ ID NO: 793 - protein, 7 aa, Synthetic construct
  REGION 1..7: note = F2
TSGNLTR

SEQ ID NO: 794 - protein, 7 aa, Synthetic construct
  REGION 1..7: note = F3
QSSDLSR

SEQ ID NO: 795 - protein, 7 aa, Synthetic construct
  REGION 1..7: note = F4
FRYYLKR

SEQ ID NO: 796 - protein, 7 aa, Synthetic construct
  REGION 1..7: note = F5
QSGDLTR

SEQ ID NO: 797 - protein, 7 aa, Synthetic construct
  REGION 1..7: note = F6
DKGNLTK

SEQ ID NO: 798 - protein, 7 aa, Synthetic construct
  REGION 1..7: note = F1
TSGSLSR

SEQ ID NO: 799 - protein, 7 aa, Synthetic construct
  REGION 1..7: note = F2
RSDNLTT

SEQ ID NO: 800 - protein, 7 aa, Synthetic construct
  REGION 1..7: note = F3
QSGNLAR

SEQ ID NO: 801 - protein, 7 aa, Synthetic construct
  REGION 1..7: note = F4
DRTTLMR

SEQ ID NO: 802 - protein, 7 aa, Synthetic construct
  REGION 1..7: note = F5
QSGHLAR

SEQ ID NO: 803 - protein, 7 aa, Synthetic construct
  REGION 1..7: note = F6
QLTHLNS

SEQ ID NO: 804 - protein, 7 aa, Synthetic construct
  REGION 1..7: note = F1
IKHDLHR

SEQ ID NO: 805 - protein, 7 aa, Synthetic construct
  REGION 1..7: note = F2
RSANLTR

SEQ ID NO: 806 - protein, 7 aa, Synthetic construct
  REGION 1..7: note = F3
RSDNLAR

SEQ ID NO: 807 - protein, 7 aa, Synthetic construct
  REGION 1..7: note = F4
QNVSRPR

SEQ ID NO: 808 - protein, 7 aa, Synthetic construct
  REGION 1..7: note = F5
RSDDLSK

SEQ ID NO: 809 - protein, 7 aa, Synthetic construct
  REGION 1..7: note = F6
DSSHRTR

SEQ ID NO: 810 - protein, 7 aa, Synthetic construct
  REGION 1..7: note = F1
RSDNLAR

SEQ ID NO: 811 - protein, 7 aa, Synthetic construct
  REGION 1..7: note = F2
QNVSRPR

SEQ ID NO: 812 - protein, 7 aa, Synthetic construct
  REGION 1..7: note = F3
RSDDLSK

SEQ ID NO: 813 - protein, 7 aa, Synthetic construct
  REGION 1..7: note = F4
DSSHRTR

SEQ ID NO: 814 - protein, 7 aa, Synthetic construct
  REGION 1..7: note = F5
TSSNRKT

SEQ ID NO: 815 - protein, 7 aa, Synthetic construct
  REGION 1..7: note = F6
AQWTRAC

SEQ ID NO: 816 - protein, 7 aa, Synthetic construct
  REGION 1..7: note = F1
RSDDLSK

SEQ ID NO: 817 - protein, 7 aa, Synthetic construct
  REGION 1..7: note = F2
DSSHRTR

SEQ ID NO: 818 - protein, 7 aa, Synthetic construct
  REGION 1..7: note = F3
TSSNRKT

SEQ ID NO: 819 - protein, 7 aa, Synthetic construct
  REGION 1..7: note = F4
AQWTRAC

SEQ ID NO: 820 - protein, 7 aa, Synthetic construct
  REGION 1..7: note = F5
RKQTRTT

SEQ ID NO: 821 - protein, 7 aa, Synthetic construct
  REGION 1..7: note = F6
HRSSLRR

SEQ ID NO: 822 - protein, 7 aa, Synthetic construct
  REGION 1..7: note = F1
QSAHRKN

SEQ ID NO: 823 - protein, 7 aa, Synthetic construct
  REGION 1..7: note = F2
TSSNRKT

SEQ ID NO: 824 - protein, 7 aa, Synthetic construct
  REGION 1..7: note = F3
RSDNLSA

SEQ ID NO: 825 - protein, 7 aa, Synthetic construct
  REGION 1..7: note = F4
RNNDRKT

SEQ ID NO: 826 - protein, 7 aa, Synthetic construct
  REGION 1..7: note = F5
TSGSLSR

SEQ ID NO: 827 - protein, 7 aa, Synthetic construct
  REGION 1..7: note = F6
QAGHLAK

SEQ ID NO: 828 - protein, 7 aa, Synthetic construct
  REGION 1..7: note = F1
RSDHLSQ

SEQ ID NO: 829 - protein, 7 aa, Synthetic construct
  REGION 1..7: note = F2
ASSTRTK

SEQ ID NO: 830 - protein, 7 aa, Synthetic construct
  REGION 1..7: note = F3
RSDDLTR

SEQ ID NO: 831 - protein, 7 aa, Synthetic construct
  REGION 1..7: note = F4
QKSNLSS

SEQ ID NO: 832 - protein, 7 aa, Synthetic construct
  REGION 1..7: note = F5
QSANRTT

SEQ ID NO: 833 - protein, 7 aa, Synthetic construct
  REGION 1..7: note = F6
QNATRTK

SEQ ID NO: 834 - protein, 7 aa, Synthetic construct
  REGION 1..7: note = F1
RSDTLSE

SEQ ID NO: 835 - protein, 7 aa, Synthetic construct
  REGION 1..7: note = F2
RRWTLVG

SEQ ID NO: 836 - protein, 7 aa, Synthetic construct
  REGION 1..7: note = F3
DRSNLSR

SEQ ID NO: 837 - protein, 7 aa, Synthetic construct
  REGION 1..7: note = F4
QSGDLTR

SEQ ID NO: 838 - protein, 7 aa, Synthetic construct
  REGION 1..7: note = F5
QSSDLSR

SEQ ID NO: 839 - protein, 7 aa, Synthetic construct
  REGION 1..7: note = F6
YHWYLKK

SEQ ID NO: 840 - protein, 7 aa, Synthetic construct
  REGION 1..7: note = F1
RSANLAR

SEQ ID NO: 841 - protein, 7 aa, Synthetic construct
  REGION 1..7: note = F2
RSDNLRE

SEQ ID NO: 842 - protein, 7 aa, Synthetic construct
  REGION 1..7: note = F3
RPYTLRL

SEQ ID NO: 843 - protein, 7 aa, Synthetic construct
  REGION 1..7: note = F4
HRSNLNK

SEQ ID NO: 844 - protein, 7 aa, Synthetic construct
  REGION 1..7: note = F5
QSGSLTR

SEQ ID NO: 845 - protein, 7 aa, Synthetic construct
  REGION 1..7: note = F6
TSANLSR

SEQ ID NO: 846 - protein, 7 aa, Synthetic construct
  REGION 1..7: note = F1
RSDDLVR

SEQ ID NO: 847 - protein, 7 aa, Synthetic construct
  REGION 1..7: note = F2
TSGSLVR

SEQ ID NO: 848 - protein, 7 aa, Synthetic construct
  REGION 1..7: note = F3
RSDKLVR

SEQ ID NO: 849 - protein, 7 aa, Synthetic construct
  REGION 1..7: note = F4
RSDELVR

SEQ ID NO: 850 - protein, 7 aa, Synthetic construct
  REGION 1..7: note = F5
TSHSLTE

SEQ ID NO: 851 - protein, 7 aa, Synthetic construct
  REGION 1..7: note = F6
RADNLTE

SEQ ID NO: 852 - protein, 7 aa, Synthetic construct
  REGION 1..7: note = F1
ERSHLRE

SEQ ID NO: 853 - protein, 7 aa, Synthetic construct
  REGION 1..7: note = F2
TSHSLTE

SEQ ID NO: 854 - protein, 7 aa, Synthetic construct
  REGION 1..7: note = F3
QAGHLAS

SEQ ID NO: 855 - protein, 7 aa, Synthetic construct
  REGION 1..7: note = F4
TSHSLTE

SEQ ID NO: 856 - protein, 7 aa, Synthetic construct
  REGION 1..7: note = F5
DPGHLVR

SEQ ID NO: 857 - protein, 7 aa, Synthetic construct
  REGION 1..7: note = F6
TSGNLVR

SEQ ID NO: 858 - protein, 7 aa, Synthetic construct
  REGION 1..7: note = F1
RADNLTE

SEQ ID NO: 859 - protein, 7 aa, Synthetic construct
  REGION 1..7: note = F2
TSGSLVR

SEQ ID NO: 860 - protein, 7 aa, Synthetic construct
  REGION 1..7: note = F3
RKDNLKN

SEQ ID NO: 861 - protein, 7 aa, Synthetic construct
  REGION 1..7: note = F4
QSSSLVR

SEQ ID NO: 862 - protein, 7 aa, Synthetic construct
  REGION 1..7: note = F5
RSDKLVR

SEQ ID NO: 863 - protein, 7 aa, Synthetic construct
  REGION 1..7: note = F6
DSGNLRV

SEQ ID NO: 864 - protein, 7 aa, Synthetic construct
  REGION 1..7: note = F1
QSSSLVR

SEQ ID NO: 865 - protein, 7 aa, Synthetic construct
  REGION 1..7: note = F2
QSGDLRR

SEQ ID NO: 866 - protein, 7 aa, Synthetic construct
  REGION 1..7: note = F3
RSDERKR

SEQ ID NO: 867 - protein, 7 aa, Synthetic construct
  REGION 1..7: note = F4
HRTTLTN

SEQ ID NO: 868 - protein, 7 aa, Synthetic construct
  REGION 1..7: note = F5
RSDHLTN

SEQ ID NO: 869 - protein, 7 aa, Synthetic construct
  REGION 1..7: note = F6
TSGELVR

SEQ ID NO: 870 - protein, 7 aa, Synthetic construct
  REGION 1..7: note = F1
QSGDLRR

SEQ ID NO: 871 - protein, 7 aa, Synthetic construct
  REGION 1..7: note = F2
RSDERKR

SEQ ID NO: 872 - protein, 7 aa, Synthetic construct
  REGION 1..7: note = F3
HRTTLTN

SEQ ID NO: 873 - protein, 7 aa, Synthetic construct
  REGION 1..7: note = F4
RSDHLTN

SEQ ID NO: 874 - protein, 7 aa, Synthetic construct
  REGION 1..7: note = F5
TSGELVR

SEQ ID NO: 875 - protein, 7 aa, Synthetic construct
  REGION 1..7: note = F6
RSDDLVR

SEQ ID NO: 876 - protein, 7 aa, Synthetic construct
  REGION 1..7: note = F1
QRAHLER

SEQ ID NO: 877 - protein, 7 aa, Synthetic construct
  REGION 1..7: note = F2
QLAHLRA

SEQ ID NO: 878 - protein, 7 aa, Synthetic construct
  REGION 1..7: note = F3
DPGHLVR

SEQ ID NO: 879 - protein, 7 aa, Synthetic construct
  REGION 1..7: note = F4
RRSACRR

SEQ ID NO: 880 - protein, 7 aa, Synthetic construct
  REGION 1..7: note = F5
RSDHLTT

SEQ ID NO: 881 - protein, 7 aa, Synthetic construct
  REGION 1..7: note = F6
QSSSLVR

SEQ ID NO: 882 - protein, 7 aa, Synthetic construct
  REGION 1..7: note = F1
QSSNLVR

SEQ ID NO: 883 - protein, 7 aa, Synthetic construct
  REGION 1..7: note = F2
RSDDLVR

SEQ ID NO: 884 - protein, 7 aa, Synthetic construct
  REGION 1..7: note = F3
THLDLIR

SEQ ID NO: 885 - protein, 7 aa, Synthetic construct
  REGION 1..7: note = F4
TSGNLTE

SEQ ID NO: 886 - protein, 7 aa, Synthetic construct
  REGION 1..7: note = F5
RRSACRR

SEQ ID NO: 887 - protein, 7 aa, Synthetic construct
  REGION 1..7: note = F6
RNDTLTE

SEQ ID NO: 888 - DNA, 540 bp, Synthetic construct
  misc_feature 1..540: note = ZFP DNA sequence
  source 1..540: mol_type = other DNA
gctgctatggcagagcggccatttcagtgtcgaatttgcatgcgaaatttctctagcgaagcggatcgaagtagacatatccggacccatacgggtgagaaaccgttcgcgtgtgatatatgcggtcgcaaattcgcagaccgctccaacctgacaaggcacacaaaaattcatactggaagccagaaaccgtttcagtgccggatttgtatgcgcaatttctctcaatcctccgatctctcccgccacatcaggactcataccggggagaaaccctttgcttgtgacatttgtggcagaaagtttgcctatcactggtaccttaagaagcacaccaagatccatactggctctcaaaagcctttccaatgccgaatatgtatgcgaaacttttctaggtctgactccctctctgtacatatccgcactcacacgggtgaaaaaccatttgcctgtgacatatgtggcagaaaatttgctcaaaatgcgaaccgaaaaacgcatacgaaaatccatttgcgacaaaaagatgcagctcgg

SEQ ID NO: 889 - DNA, 540 bp, Synthetic construct
  misc_feature 1..540: note = ZFP DNA sequence
  source 1..540: mol_type = other DNA
gcggcaatggcagaacgcccgtttcagtgtagaatctgcatgcgcaatttctccagaagtgacgtactcagcacgcatatcagaacacatactggtgaaaaaccgtttgcttgtgatatctgtggtaagaaattcgcggataactcctcaaggacgcggcatacgaagatccacactggttctcaaaagccgttccagtgccggatatgcatgcggaactttagtcggccatatacgcttcgacttcatattaggactcacaccggcgaaaagccgttcgcctgtgacatttgcgggagaaaattcgctgactctagtcaccgcacgaggcacactaaaatacatactggttcacaaaaaccattccagtgccgaatttgcatgcgaaatttttcccgaagtgaccatctctcacagcacatccgcacccatacaggggagaagcccttcgcttgtgatatatgcggacgcaagttcgcggacagctcacaccggacccgccatacaaagatccacttgagacagaaagatgcagcgcgg

SEQ ID NO: 890 - DNA, 540 bp, Synthetic construct
  misc_feature 1..540: note = ZFP DNA sequence
  source 1..540: mol_type = other DNA
gccgcaatggccgaaagaccatttcagtgcaggatatgtatgcgcaacttctctcgcagtgaccacctgagtcaacatatcaggacacacacgggtgaaaagccttttgcatgcgatatttgtggtcgaaaatttgctcagtctgcggaccgaaccaagcacactaaaattcataccggctcacagaaaccgtttcaatgccgcatctgtatgaggaatttctctagatcagaccacttgtcccaacacatccggactcatactggagaaaagccgtttgcatgtgacatttgtggcaggaagtttgctagaaggtctgaccttaaaaggcacacaaaaattcatacgggttcccagaaaccatttcagtgccggatatgcatgcggaacttttcacgaagcgaccacctctcccgacatattcgaacgcacactggtgagaagccgtttgcttgcgacatttgcggacgcaagttcgctcagagctccgacttgaggaggcataccaagattcatctccggcagaaagatgccgcgcgg

SEQ ID NO: 891 - DNA, 540 bp, Synthetic construct
  misc_feature 1..540: note = ZFP DNA sequence
  source 1..540: mol_type = other DNA
gccgcgatggctgagagaccatttcagtgtcgaatctgcatgagaaatttttcaaggagtgacaatctgtctgagcacatacgaacacatactggggaaaaaccctttgcatgtgacatttgtggaagaaagtttgctaccagctcaaatcgcaaaacacatacaaagatacataccggctcccaaaagccattccagtgccgcatctgcatgaggaacttttccgatcgctcacatcttacccgccacataagaactcacacaggcgaaaagccctttgcctgcgatatatgcggacggaagttcgcccgctccgacgctttgacccagcataccaaaatccatactgggtctcaaaagccatttcagtgccgaatctgtatgaggaatttctccgacaggtcagcattggcacggcatatccgcacccataccggtgagaagccttttgcttgcgatatctgtggacgaaaatttgcccggaggttcactctctccaaacacacaaagatacatctgcgccaaaaggatgcagcccgg

SEQ ID NO: 892 - DNA, 540 bp, Synthetic construct
  misc_feature 1..540: note = ZFP DNA sequence
  source 1..540: mol_type = other DNA
gccgcaatggctgagcgcccgttccagtgcagaatatgcatgcggaatttttctaggtcagatcatttgtctgagcatattcgcacacacacgggagagaagccctttgcttgcgatatatgtggaaggaaattcgcgcaatacagtgggcgctactaccatacaaagatccatacgggctcccagaagcccttccaatgtcgaatatgtatgaggaattttagtcacggacaaacattgaatgaacatatacgcactcacactggtgaaaaaccatttgcgtgcgatatttgcggaaggaagtttgctcagtctgggaatttggcgcgacacaccaagatccacacaggatcccagaaaccatttcagtgcagaatttgtatgagaaactttagccgcagtgacagtctcttgaggcacatacggactcatactggggagaaaccattcgcctgcgatatttgtggacgaaagttcgcctgtcgcgagtacagaggcaagcacactaagatacatcttaggcaaaaggacgctgcacgg

SEQ ID NO: 893 - DNA, 540 bp, Synthetic construct
  misc_feature 1..540: note = ZFP DNA sequence
  source 1..540: mol_type = other DNA
gccgcgatggctgagaggccttttcaatgtcgaatctgtatgaggaacttctctcaatctgctaatcgcacgacgcacattcgaacgcataccggtgagaagccattcgcgtgcgatatctgcggacggaaattcgcgaggtcagctaatcttacacggcacacgaagatccacacagggtcacagaaaccttttcagtgtcgcatttgcatgaggaatttctcccgatctgacgtccttagcgaacatatacgaactcacacgggcgagaagccatttgcgtgcgatatatgcgggaggaagtttgccacctctggacatctgagtcgacataccaaaattcataccggtagtcagaagccgttccaatgcagaatatgtatgcgaaatttctctcaaagctcagacttgtctaggcacataagaacgcacacgggtgaaaaacctttcgcgtgtgatatctgcggcagaaagttcgcacaatggtccacccgaaagcggcatacgaagattcacctcagacagaaagacgctgcccgg

SEQ ID NO: 894 - DNA, 540 bp, Synthetic construct
  misc_feature 1..540: note = ZFP DNA sequence
  source 1..540: mol_type = other DNA
gcggcgatggcagaacgcccgttccaatgcagaatatgtatgagaaacttctcccagagcggaaatctggcacgccacatccggacacacacgggagagaagccatttgcttgtgacatttgtggtcgcaaatttgccgccacctgttgtctggcacatcatactaagatacatacggggtcacagaaaccattccaatgtaggatctgcatgcggaatttttctcggtggcagtatttgcctacgcatattagaacccacgccggtgagaaaccgtttgcatgtgacatctgcggacgaaagtttgccgatagatctgcgcttgctaggcatactaaaatccacacggggtcccagaagccttttcagtgtcggatatgtatgaggaacttcagtcgatcagacaaccttagcgagcatattcggacgcatactggagaaaaaccttttgcttgtgatatatgcggtaggaagttcgccaaacggtgtaaccttcgctgtcacaccaaaatacatcttcgccagaaagatgcggcccgg

SEQ ID NO: 895 - DNA, 540 bp, Synthetic construct
  misc_feature 1..540: note = ZFP DNA sequence
  source 1..540: mol_type = other DNA
gccgctatggctgaaagaccattccagtgcagaatatgtatgaggaatttttctaatcccgcgaaccttacgcgccatatcaggacgcacacgggcgaaaagcccttcgcctgcgacatttgtgggagaaagtttgctcaaaacgcgaccaggacaaagcacacgaaaattcacactggtagccagaagccgttccagtgtaggatctgtatgcgcaatttctctcagtccgggcacctcgcgcgacacataagaactcatacgggggagaagccgtttgcatgtgacatctgcggccgcaagtttgcgaataggcatgacagggcaaaacatacgaagatccatacaggttctcaaaaacctttccaatgtcgaatatgcatgcgcaactttagtcggtcagaccacctttctgaacacatcaggacacacactggcgaaaagccgttcgcatgtgacatttgcggcagaaagttcgcacaaagacggtcccgctataagcacaccaaaattcaccttaggcaaaaggatgcagctcgg

SEQ ID NO: 896 - DNA, 540 bp, Synthetic construct
  misc_feature 1..540: note = ZFP DNA sequence
  source 1..540: mol_type = other DNA
gcggcaatggcagaacgacccttccaatgccgcatatgtatgcgaaacttcagccagagctcagatctttccagacacatcaggactcacactggcgaaaaaccatttgcatgcgatatatgcgggagaaaattcgcgcaccgcagtacgcgaaacaggcatacaaagatacatactggcagtcaaaagccatttcaatgtcgaatatgcatgaggaactttagtcgatctgacgtgctgagcgctcacatacggacccataccggagagaaaccattcgcttgtgacatctgtggtaggaagttcgcggattcccggacccgcaaaaatcatactaaaattcacactgggtctcagaagccctttcagtgtaggatatgtatgcgcaattttagccagagtggttcattgactcggcatatcagaacacatactggagagaaacctttcgcgtgtgatatttgcggtcgaaagttcgcagatcagagtggacttgcgcaccatactaagatccacctgagacagaaggacgctgcgcgg

SEQ ID NO: 897 - DNA, 540 bp, Synthetic construct
  misc_feature 1..540: note = ZFP DNA sequence
  source 1..540: mol_type = other DNA
gctgccatggcggagcgccctttccagtgtaggatatgtatgcgcaacttcagtcagaacccagcccagtggcggcacatacggacgcatactggagaaaagccatttgcatgtgatatctgcgggcgaaaattcgcgcggtcagcagatttgagccggcatacgaagatccatacaggttcacaaaagccatttcaatgtcggatatgtatgcggaacttcagcacgtccggctcattgtcaagacatatacgaactcataccggagagaaacccttcgcgtgcgacatttgcggtcggaagttcgcgcgatccgaccatctgtcacgacatacgaaaatacacactggctctcaaaagccgtttcagtgcagaatttgcatgagaaattttagcaggagcgactcactccttcggcatatacgaacacacactggtgagaagccatttgcctgtgatatttgtggacgaaagtttgcgcaatcttacgataggtttcagcatacaaaaatccaccttcggcaaaaggacgcggcacgg

SEQ ID NO: 898 - DNA, 540 bp, Synthetic construct
  misc_feature 1..540: note = ZFP DNA sequence
  source 1..540: mol_type = other DNA
gctgccatggctgaacgaccgtttcaatgtcgaatttgcatgcgcaacttctccacgtccgggtctctcagtagacacatcagaacgcatactggtgaaaaaccattcgcttgtgacatatgcggccgaaaattcgcgcggagcgaccacctgtcacggcataccaaaattcacaccgggagtcaaaaaccgttccagtgtaggatatgtatgcgcaacttcagccggtctgacagtctgcttcgacatattcggacgcacactggtgaaaagccgtttgcgtgcgacatttgtggtcgaaagttcgctcaatcttatgataggtttcaacacaccaaaatacatacgggctcccagaagccgttccagtgcagaatatgcatgagaaatttctctcgcagtgacaatttgtccacccatattcgaacgcacaccggcgagaaacccttcgcctgcgatatttgcggtcgcaagttcgcagacaacagggataggataaaacatacgaagatccatctgaggcaaaaagacgccgcccgg

SEQ ID NO: 899 - DNA, 540 bp, Synthetic construct
  misc_feature 1..540: note = ZFP DNA sequence
  source 1..540: mol_type = other DNA
gcagccatggcagagcggccattccagtgcagaatctgcatgcggaacttttccgataggtccaatctgtcacgccatattaggacacacacgggtgaaaaaccgttcgcgtgtgacatatgcggtcgcaaattcgccctgagacagaacctgattatgcacacaaaaatacatacgggaagccagaaaccgttccagtgtcggatatgcatgaggaacttcagtgagagggggactttggcgaggcacatcaggactcacactggggagaagccctttgcatgtgatatctgtggccgaaaatttgctcgatcagatgctctcacccaacatacaaagatccatactggctctcaaaaaccgtttcaatgtagaatttgtatgcgcaacttctctcggtcagatagcctgtcccagcatatccgaactcatacaggtgagaaacccttcgcatgcgacatctgtgggcgaaaatttgctagaaaagcagaccggacccgacacacaaagattcatctgcgacaaaaagacgccgcccgg

SEQ ID NO: 900 - DNA, 540 bp, Synthetic construct
  misc_feature 1..540: note = ZFP DNA sequence
  source 1..540: mol_type = other DNA
gcggccatggctgagaggccttttcaatgtagaatatgtatgcgaaatttttcacagtactgttgtctcacgaaccacataaggactcatacaggggagaaaccatttgcctgtgacatttgcggtcgcaaatttgctacttctggaaacctgactcggcacactaagattcacacagggtcccagaagcccttccagtgtcgcatttgcatgaggaattttagtcaaagctctgacttgtcaaggcatattcgcacgcacacgggcgaaaagccgttcgcttgcgacatatgcgggcggaaatttgccttccgctattatttgaagagacacaccaagatacatacgggctctcagaagccctttcagtgtaggatttgcatgcgcaatttttcacaatctggtgatctcacgcgacacatccggactcacacaggtgaaaagcctttcgcgtgcgacatttgcggccggaagtttgctgacaagggcaacctcacaaagcatacgaagattcacttgaggcagaaagatgctgctcgg

SEQ ID NO: 901 - DNA, 540 bp, Synthetic construct
  misc_feature 1..540: note = ZFP DNA sequence
  source 1..540: mol_type = other DNA
gccgccatggccgaacgaccattccagtgcaggatatgtatgcgcaatttttcaaccagtggttcattgtcacgacatattagaacacacaccggtgagaaaccctttgcgtgtgacatctgtgggaggaaattcgcaagatctgacaaccttacgacacatacaaagattcacacaggctctcaaaagcccttccagtgccgaatttgcatgcgaaacttttcccagtctggtaatctcgctcgacatatcagaacccacacgggggaaaaaccattcgcttgtgatatttgcggacgaaagttcgccgacagaaccacactcatgagacacactaaaatccatactggtagtcagaagccgtttcagtgtagaatctgcatgaggaacttttcccagtcaggccaccttgcaagacatatacgaactcacactggagaaaagccgttcgcctgtgacatttgtgggcgcaagttcgcgcaactcacccatctgaatagccatacgaagattcacttgagacagaaagatgcggctcgg

SEQ ID NO: 902 - DNA, 540 bp, Synthetic construct
  misc_feature 1..540: note = ZFP DNA sequence
  source 1..540: mol_type = other DNA
gcagctatggctgaacgcccattccagtgtcggatctgcatgcgcaacttttctataaaacacgatcttcaccgacacattcggacacatactggggagaagccctttgcgtgtgacatctgtggccgaaagttcgctagatccgcaaacttgactcggcatacgaaaattcacactggaagccagaaacctttccaatgtcgaatctgtatgaggaactttagcagaagtgataatctcgccaggcatatccgaacgcacacaggcgagaagccattcgcatgtgatatttgtggtagaaagttcgcccaaaatgtctctcgcccacgccatactaagatccacacgggctcccagaagccgttccaatgccgcatttgcatgcgaaacttttccagatcagacgatctgagcaagcatattaggacgcatacaggggagaagccttttgcttgcgacatttgcggccggaaatttgctgactcaagtcacagaacacggcataccaagatacaccttcgacaaaaagatgccgcacgg

SEQ ID NO: 903 - DNA, 540 bp, Synthetic construct
  misc_feature 1..540: note = ZFP DNA sequence
  source 1..540: mol_type = other DNA
gcggccatggcggaacgaccctttcagtgccgaatttgcatgaggaacttttcacgatctgataacctggcgaggcacatccgaacacatacgggcgagaagccattcgcatgtgatatctgcgggcgaaagttcgcccaaaatgtcagtagaccgcgacatactaaaatacacactggctcacagaagccgttccaatgccgcatctgtatgcgcaatttttcccgaagcgacgatctgtctaaacatattcggacgcacactggggaaaagcctttcgcttgtgacatctgtgggaggaagttcgctgacagctctcataggacacgccatactaagattcataccggaagccagaagcctttccagtgtcggatttgcatgagaaactttagcacttctagcaacagaaagacacatatacgaacccatacgggtgagaaaccgttcgcatgcgatatctgtgggcgaaaatttgcagcccaatggaccagagcttgccataccaagatacaccttcggcagaaggacgctgcacgg

SEQ ID NO: 904 - DNA, 540 bp, Synthetic construct
  misc_feature 1..540: note = ZFP DNA sequence
  source 1..540: mol_type = other DNA
gctgcgatggcagaacgaccttttcaatgccgaatttgtatgaggaacttttcccggtcagacgacctttccaagcacatcagaactcataccggagaaaaaccgttcgcctgtgacatttgtggacggaagtttgctgactcctctcacaggactcgccacactaagatacacaccggaagtcagaagcccttccaatgtaggatatgcatgagaaacttcagtacgtcatcaaaccgaaaaacgcatatcaggacacataccggcgaaaagccgtttgcatgtgatatctgcggcaggaaatttgcagctcagtggacacgggcatgtcacacaaaaatccataccggtagtcaaaaaccgtttcagtgtcgaatctgcatgaggaactttagccggaagcagacgagaaccacgcatataagaactcacacaggtgagaaaccctttgcgtgcgatatctgcggtcgcaaatttgctcaccgatcctccctgaggcgacatactaaaatacatctgcgacagaaagacgcggctcgg

SEQ ID NO: 905 - DNA, 540 bp, Synthetic construct
  misc_feature 1..540: note = ZFP DNA sequence
  source 1..540: mol_type = other DNA
gccgccatggcagaacggccttttcagtgtcggatctgcatgagaaactttagtcagagtgcccatcgcaagaatcatattcgaactcataccggtgaaaaaccgttcgcgtgcgacatctgtggtcgaaagtttgccacatcatccaatagaaaaacgcatactaagattcataccggtagccagaaaccattccaatgtagaatctgcatgcgaaatttcagcaggagtgacaatttgtccgcacatatacggacacacacgggcgaaaaaccctttgcttgcgatatatgcggtagaaagttcgctaggaacaacgaccgaaaaacacacacgaagattcatacaggtagtcagaagccatttcaatgtcggatctgtatgcgaaatttctctacttctggcagcctgtcccggcacatcagaacacataccggtgagaagccatttgcatgtgacatatgtgggagaaaatttgcccaggcgggtcaccttgcgaagcatacaaagatccacctccgccagaaggacgccgcacgg

SEQ ID NO: 906 - DNA, 540 bp, Synthetic construct
  misc_feature 1..540: note = ZFP DNA sequence
  source 1..540: mol_type = other DNA
gcggctatggcagagcggccattccaatgtaggatatgtatgaggaacttctcccggagcgatcacctgtcccaacacatccgcacgcatacgggtgagaagccgtttgcttgtgatatctgcggaagaaaatttgcagcatccagtacacgcacaaagcatacgaagattcatacgggatcccaaaagccctttcaatgcaggatttgtatgaggaacttcagtcggtccgacgatctgacacgacatattagaactcatactggagagaagccattcgcatgtgacatctgcggtaggaagttcgcgcagaaatctaacctgtcatctcacaccaagatacatacaggctcacagaagccgtttcaatgccgcatctgcatgaggaatttcagccagtccgcaaacagaactacgcatattcggacgcataccggcgagaagccgtttgcctgcgacatttgcgggaggaaattcgcacagaacgcgaccagaaccaaacacaccaaaatccatcttaggcaaaaggatgcggcccgg

SEQ ID NO: 907 - DNA, 540 bp, Synthetic construct
  misc_feature 1..540: note = ZFP DNA sequence
  source 1..540: mol_type = other DNA
gcggccatggcagaacgaccctttcagtgccgaatttgcatgcggaactttagtcgcagtgacaccctgagcgagcatattcgcacgcatacgggagagaagccatttgcatgcgacatctgcggtagaaagtttgcgaggcgctggacgttggtaggccacacgaaaatccatacaggctcccagaaacccttccagtgcagaatttgtatgcgcaattttagtgacagaagtaacttgtcccgacatataaggacgcacaccggcgaaaaaccgtttgcctgtgatatctgtggtcggaaattcgcccagtccggtgacttgacacggcataccaaaatacacactggaagccaaaagccttttcagtgtcgcatatgtatgcgcaacttcagccagagtagtgacctttcacggcatatacggacgcatacgggtgagaaacccttcgcctgtgacatttgcgggcgaaagtttgcatatcattggtacctgaaaaaacatacgaaaatacatttgagacaaaaagatgcagcccgg

SEQ ID NO: 908 - DNA, 540 bp, Synthetic construct
  misc_feature 1..540: note = ZFP DNA sequence
  source 1..540: mol_type = other DNA
gctgccatggccgagcgcccgtttcaatgcagaatatgtatgaggaacttctctagaagcgccaatcttgcgcgacacattagaactcacacaggcgagaaacctttcgcctgtgacatctgcggcagaaaatttgcgcgaagtgataacttgcgcgagcacacaaaaatccataccggttcccaaaagccctttcaatgtaggatttgcatgaggaacttttcaagaccatacacgctgagactccacattcgcacgcatacgggagaaaaaccatttgcttgtgacatatgcggccgaaagtttgcacaccgatccaacttgaataagcataccaaaatccatacggggtctcagaaacccttccagtgtcggatttgtatgcgaaacttctctcagagtggttctcttacgcgccacattagaacccacacgggggaaaagccattcgcgtgcgatatctgtggccggaaatttgctacttccgcaaatctttctcgacatacaaagatacatcttagacagaaggatgcggcacgg

SEQ ID NO: 909 - DNA, 528 bp, Synthetic construct
  misc_feature 1..528: note = ZFP DNA sequence
  source 1..528: mol_type = other DNA
ttggagcccggtgaaaaaccatatgcctgtccagagtgtggaaaaagttttagcagaagcgacgacctggttaggcatcaacgaactcacacaggggaaaagccgtacaaatgtcctgaatgcggaaagtcattctccacttcaggtagcctcgtgcgacatcagcgcacacatactggcgaaaaaccttataagtgtccggaatgcggcaagagtttttctagaagtgataagctcgtgcgacaccagcggacgcacacgggtgagaagccctacgcctgcccagagtgcggaaagtcctttagtaggtctgacgaactggtccggcaccaacgaacccatacaggggagaaaccctacaaatgtccagagtgcgggaaatcattttcaacgtctcacagcttgacggaacatcagaggacccatacaggcgaaaagccttacaaatgtccggagtgcggaaagtctttcagccgggctgataatctcacggagcaccaaagaacccacacgggtaagaaaacctct

SEQ ID NO: 910 - DNA, 528 bp, Synthetic construct
  misc_feature 1..528: note = ZFP DNA sequence
  source 1..528: mol_type = other DNA
ttggagccgggagaaaagccatatgcctgtccggaatgcggcaaaagcttttcagaacggtcccatttgcgggaacatcagcgcacccataccggagaaaagccttacaagtgtcccgagtgtggtaagagcttttcaacttcccacagtctcactgaacatcagcgaactcacacaggcgaaaaaccatacaaatgcccggagtgtggaaagagtttttctcaagctgggcacttggccagccaccaaaggactcatacgggcgagaaaccgtatgcctgtccagaatgcgggaaatcattttctactagtcattcccttacggaacatcagagaacgcacaccggggagaagccatacaagtgtccggagtgcggaaaatcattctccgacccgggtcatctcgttcgccatcagaggactcatactggagagaaaccgtataaatgtcctgaatgcgggaagagcttttctacatctgggaaccttgtgcggcaccagcgaacccacacggggaaaaagacttct

SEQ ID NO: 911 - DNA, 528 bp, Synthetic construct
  misc_feature 1..528: note = ZFP DNA sequence
  source 1..528: mol_type = other DNA
ctggaaccgggtgaaaaaccctacgcttgtcccgagtgtgggaaatcattctcaagggcagataatcttacggaacatcagcgcacacacaccggggaaaaaccctataagtgccctgagtgtggtaaatcattctctacgtcagggtcattggtgcgccatcagaggacccatacaggcgaaaaaccgtataagtgccccgaatgcggtaaaagcttcagcagaaaagataacttgaaaaatcaccaacgcactcacacgggagaaaaaccgtacgcatgcccggagtgcggcaagagtttcagtcagagtagctcacttgttcgccaccaaagaacccacacaggcgaaaagccctacaagtgtcctgaatgtggaaagagtttcagtcgaagtgataaattggttaggcaccaaagaacacacactggagagaaaccgtacaagtgtccagaatgtggcaagtctttttctgattctggaaatttgcgcgtccatcaaaggactcatactgggaaaaagacgtcc

SEQ ID NO: 912 - DNA, 528 bp, Synthetic construct
  misc_feature 1..528: note = ZFP DNA sequence
  source 1..528: mol_type = other DNA
ctcgaaccaggggaaaagccatacgcttgccccgagtgtggaaaatctttctctcagtcaagctcccttgtcagacaccagagaacccatacgggtgagaaaccatacaagtgcccagagtgcggcaaaagcttcagtcagagtggcgatctgcgccggcatcaaagaactcacactggagaaaagccctataagtgccccgaatgtggaaagagtttttccaggagtgacgaaagaaagagacaccagcggactcacaccggcgagaaaccatacgcatgccccgagtgcggaaaaagtttttcccaccgcacaacccttaccaatcatcaacgcacgcacacaggggagaaaccctacaagtgcccggagtgtggcaagtcattcagccgaagtgaccacctcactaaccaccaaaggactcacacaggagaaaaaccctacaaatgtccggagtgcggaaaatctttttccacgtccggtgagctggtccgccatcaacgaacccatactggtaaaaaaactagc

SEQ ID NO: 913 - DNA, 528 bp, Synthetic construct
  misc_feature 1..528: note = ZFP DNA sequence
  source 1..528: mol_type = other DNA
ctggaacccggggagaagccgtacgcttgcccagagtgcggaaagagcttctctcagagcggagaccttagacgccaccagcgaacccacaccggcgaaaaaccgtataaatgcccggaatgcggcaagagttttagtcggtccgatgagcgaaagaggcatcaacgaacccatacgggagagaaaccctacaagtgccctgagtgtggtaagtcattttcccacagaacgacgttgacgaatcaccagagaacccatacgggtgagaaaccttacgcttgcccggagtgcggcaaaagcttcagccggagtgatcacttgaccaatcatcagaggacacacacgggtgagaagccctacaaatgtcccgaatgcggcaagtctttctcaacgtcaggcgaactcgtccggcaccagcgaacacatacgggagaaaagccgtacaaatgtccggaatgcggaaagtcattttcacggtcagatgacttggtgcgacaccagcgcactcacacaggcaagaagacctca

SEQ ID NO: 914 - DNA, 528 bp, Synthetic construct
  misc_feature 1..528: note = ZFP DNA sequence
  source 1..528: mol_type = other DNA
ctggagcctggtgagaagccgtatgcatgtcctgagtgtgggaagtcatttagtcagagggcccacttggaacgacaccaaaggacccacactggtgaaaaaccctacaaatgcccagagtgtggtaagtctttttcacagctggcccacctgagagcacaccagcgaactcatacgggcgagaaaccatacaagtgtccagagtgcggaaagtcattctcagatcccggccacttggtgcgacatcagagaacgcacacaggggagaagccttatgcttgcccggaatgcgggaagtctttcagccgccgaagtgcttgtcgaaggcaccaacggacccataccggtgagaaaccatataagtgcccagagtgtggaaagagttttagtcgatccgatcacctgactacgcaccagcggacgcacacaggagagaaaccgtataagtgccctgaatgcggtaagagcttctctcaatcaagctcactggttaggcaccaacgcactcataccggcaagaagacgtca

SEQ ID NO: 915 - DNA, 528 bp, Synthetic construct
  misc_feature 1..528: note = ZFP DNA sequence
  source 1..528: mol_type = other DNA
cttgagccgggggaaaagccttatgcttgcccagagtgtggcaagagcttctcccaaagttcaaacctcgtccgacaccaaaggactcacacgggcgaaaaaccgtataaatgccccgagtgcggaaagtcattttccaggtccgacgatctggtccgccaccagcgcactcatacgggggaaaagccctataagtgccctgagtgcggcaagagcttctcaactcacctggatctcattcgccatcaacgcacacatacaggggagaagccttacgcttgtccagagtgcggcaagtctttcagtacgagcggaaacctgacggaacaccagcgaacccacacgggcgagaagccatataaatgtcccgaatgtggaaaatcattctctcgccgatctgcgtgccgccggcatcagaggacacataccggagaaaagccgtacaaatgccccgagtgtggaaaatcctttagcagaaatgatacacttaccgagcatcagaggacgcacactggaaaaaagacatct

SEQ ID NO: 916 - DNA, 825 bp, Synthetic construct
  misc_feature 1..825: note = 3xFLAG-SV40 NLS--ZFP-SV40-NLS-KRAB (DNA Sequence)
  source 1..825: mol_type = other DNA
atggcaccgaagaaaaaacgcaaagttggtcgagtacccgctgctatggcagagcggccatttcagtgtcgaatttgcatgcgaaatttctctagcgaagcggatcgaagtagacatatccggacccatacgggtgagaaaccgttcgcgtgtgatatatgcggtcgcaaattcgcagaccgctccaacctgacaaggcacacaaaaattcatactggaagccagaaaccgtttcagtgccggatttgtatgcgcaatttctctcaatcctccgatctctcccgccacatcaggactcataccggggagaaaccctttgcttgtgacatttgtggcagaaagtttgcctatcactggtaccttaagaagcacaccaagatccatactggctctcaaaagcctttccaatgccgaatatgtatgcgaaacttttctaggtctgactccctctctgtacatatccgcactcacacgggtgaaaaaccatttgcctgtgacatatgtggcagaaaatttgctcaaaatgcgaaccgaaaaacgcatacgaaaatccatttgcgacaaaaagatgcagctcggggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 917 - DNA, 825 bp, Synthetic construct
  misc_feature 1..825: note = 3xFLAG-SV40 NLS--ZFP-SV40-NLS-KRAB (DNA Sequence)
  source 1..825: mol_type = other DNA
atggcaccgaagaaaaaacgcaaagttggtcgagtacccgcggcaatggcagaacgcccgtttcagtgtagaatctgcatgcgcaatttctccagaagtgacgtactcagcacgcatatcagaacacatactggtgaaaaaccgtttgcttgtgatatctgtggtaagaaattcgcggataactcctcaaggacgcggcatacgaagatccacactggttctcaaaagccgttccagtgccggatatgcatgcggaactttagtcggccatatacgcttcgacttcatattaggactcacaccggcgaaaagccgttcgcctgtgacatttgcgggagaaaattcgctgactctagtcaccgcacgaggcacactaaaatacatactggttcacaaaaaccattccagtgccgaatttgcatgcgaaatttttcccgaagtgaccatctctcacagcacatccgcacccatacaggggagaagcccttcgcttgtgatatatgcggacgcaagttcgcggacagctcacaccggacccgccatacaaagatccacttgagacagaaagatgcagcgcggggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 918 - DNA, 825 bp, Synthetic construct
  misc_feature 1..825: note = 3xFLAG-SV40 NLS--ZFP-SV40-NLS-KRAB (DNA Sequence)
  source 1..825: mol_type = other DNA
atggcaccgaagaaaaaacgcaaagttggtcgagtacccgccgcaatggccgaaagaccatttcagtgcaggatatgtatgcgcaacttctctcgcagtgaccacctgagtcaacatatcaggacacacacgggtgaaaagccttttgcatgcgatatttgtggtcgaaaatttgctcagtctgcggaccgaaccaagcacactaaaattcataccggctcacagaaaccgtttcaatgccgcatctgtatgaggaatttctctagatcagaccacttgtcccaacacatccggactcatactggagaaaagccgtttgcatgtgacatttgtggcaggaagtttgctagaaggtctgaccttaaaaggcacacaaaaattcatacgggttcccagaaaccatttcagtgccggatatgcatgcggaacttttcacgaagcgaccacctctcccgacatattcgaacgcacactggtgagaagccgtttgcttgcgacatttgcggacgcaagttcgctcagagctccgacttgaggaggcataccaagattcatctccggcagaaagatgccgcgcggggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 919 - DNA, 825 bp, Synthetic construct
  misc_feature 1..825: note = 3xFLAG-SV40 NLS--ZFP-SV40-NLS-KRAB (DNA Sequence)
  source 1..825: mol_type = other DNA
atggcaccgaagaaaaaacgcaaagttggtcgagtacccgccgcgatggctgagagaccatttcagtgtcgaatctgcatgagaaatttttcaaggagtgacaatctgtctgagcacatacgaacacatactggggaaaaaccctttgcatgtgacatttgtggaagaaagtttgctaccagctcaaatcgcaaaacacatacaaagatacataccggctcccaaaagccattccagtgccgcatctgcatgaggaacttttccgatcgctcacatcttacccgccacataagaactcacacaggcgaaaagccctttgcctgcgatatatgcggacggaagttcgcccgctccgacgctttgacccagcataccaaaatccatactgggtctcaaaagccatttcagtgccgaatctgtatgaggaatttctccgacaggtcagcattggcacggcatatccgcacccataccggtgagaagccttttgcttgcgatatctgtggacgaaaatttgcccggaggttcactctctccaaacacacaaagatacatctgcgccaaaaggatgcagcccggggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 920 - DNA, 825 bp, Synthetic construct
  misc_feature 1..825: note = 3xFLAG-SV40 NLS--ZFP-SV40-NLS-KRAB (DNA Sequence)
  source 1..825: mol_type = other DNA
atggcaccgaagaaaaaacgcaaagttggtcgagtacccgccgcaatggctgagcgcccgttccagtgcagaatatgcatgcggaatttttctaggtcagatcatttgtctgagcatattcgcacacacacgggagagaagccctttgcttgcgatatatgtggaaggaaattcgcgcaatacagtgggcgctactaccatacaaagatccatacgggctcccagaagcccttccaatgtcgaatatgtatgaggaattttagtcacggacaaacattgaatgaacatatacgcactcacactggtgaaaaaccatttgcgtgcgatatttgcggaaggaagtttgctcagtctgggaatttggcgcgacacaccaagatccacacaggatcccagaaaccatttcagtgcagaatttgtatgagaaactttagccgcagtgacagtctcttgaggcacatacggactcatactggggagaaaccattcgcctgcgatatttgtggacgaaagttcgcctgtcgcgagtacagaggcaagcacactaagatacatcttaggcaaaaggacgctgcacggggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 921 - DNA, 825 bp, Synthetic construct
  misc_feature 1..825: note = 3xFLAG-SV40 NLS--ZFP-SV40-NLS-KRAB (DNA Sequence)
  source 1..825: mol_type = other DNA
atggcaccgaagaaaaaacgcaaagttggtcgagtacccgccgcgatggctgagaggccttttcaatgtcgaatctgtatgaggaacttctctcaatctgctaatcgcacgacgcacattcgaacgcataccggtgagaagccattcgcgtgcgatatctgcggacggaaattcgcgaggtcagctaatcttacacggcacacgaagatccacacagggtcacagaaaccttttcagtgtcgcatttgcatgaggaatttctcccgatctgacgtccttagcgaacatatacgaactcacacgggcgagaagccatttgcgtgcgatatatgcgggaggaagtttgccacctctggacatctgagtcgacataccaaaattcataccggtagtcagaagccgttccaatgcagaatatgtatgcgaaatttctctcaaagctcagacttgtctaggcacataagaacgcacacgggtgaaaaacctttcgcgtgtgatatctgcggcagaaagttcgcacaatggtccacccgaaagcggcatacgaagattcacctcagacagaaagacgctgcccggggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 922 - DNA, 825 bp, Synthetic construct
  misc_feature 1..825: note = 3xFLAG-SV40 NLS--ZFP-SV40-NLS-KRAB (DNA Sequence)
  source 1..825: mol_type = other DNA
atggcaccgaagaaaaaacgcaaagttggtcgagtacccgcggcgatggcagaacgcccgttccaatgcagaatatgtatgagaaacttctcccagagcggaaatctggcacgccacatccggacacacacgggagagaagccatttgcttgtgacatttgtggtcgcaaatttgccgccacctgttgtctggcacatcatactaagatacatacggggtcacagaaaccattccaatgtaggatctgcatgcggaatttttctcggtggcagtatttgcctacgcatattagaacccacgccggtgagaaaccgtttgcatgtgacatctgcggacgaaagtttgccgatagatctgcgcttgctaggcatactaaaatccacacggggtcccagaagccttttcagtgtcggatatgtatgaggaacttcagtcgatcagacaaccttagcgagcatattcggacgcatactggagaaaaaccttttgcttgtgatatatgcggtaggaagttcgccaaacggtgtaaccttcgctgtcacaccaaaatacatcttcgccagaaagatgcggcccggggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 923 - DNA, 825 bp, Synthetic construct
  misc_feature 1..825: note = 3xFLAG-SV40 NLS--ZFP-SV40-NLS-KRAB (DNA Sequence)
  source 1..825: mol_type = other DNA
atggcaccgaagaaaaaacgcaaagttggtcgagtacccgccgctatggctgaaagaccattccagtgcagaatatgtatgaggaatttttctaatcccgcgaaccttacgcgccatatcaggacgcacacgggcgaaaagcccttcgcctgcgacatttgtgggagaaagtttgctcaaaacgcgaccaggacaaagcacacgaaaattcacactggtagccagaagccgttccagtgtaggatctgtatgcgcaatttctctcagtccgggcacctcgcgcgacacataagaactcatacgggggagaagccgtttgcatgtgacatctgcggccgcaagtttgcgaataggcatgacagggcaaaacatacgaagatccatacaggttctcaaaaacctttccaatgtcgaatatgcatgcgcaactttagtcggtcagaccacctttctgaacacatcaggacacacactggcgaaaagccgttcgcatgtgacatttgcggcagaaagttcgcacaaagacggtcccgctataagcacaccaaaattcaccttaggcaaaaggatgcagctcggggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 924 - DNA, 825 bp, Synthetic construct
  misc_feature 1..825: note = 3xFLAG-SV40 NLS--ZFP-SV40-NLS-KRAB (DNA Sequence)
  source 1..825: mol_type = other DNA
atggcaccgaagaaaaaacgcaaagttggtcgagtacccgcggcaatggcagaacgacccttccaatgccgcatatgtatgcgaaacttcagccagagctcagatctttccagacacatcaggactcacactggcgaaaaaccatttgcatgcgatatatgcgggagaaaattcgcgcaccgcagtacgcgaaacaggcatacaaagatacatactggcagtcaaaagccatttcaatgtcgaatatgcatgaggaactttagtcgatctgacgtgctgagcgctcacatacggacccataccggagagaaaccattcgcttgtgacatctgtggtaggaagttcgcggattcccggacccgcaaaaatcatactaaaattcacactgggtctcagaagccctttcagtgtaggatatgtatgcgcaattttagccagagtggttcattgactcggcatatcagaacacatactggagagaaacctttcgcgtgtgatatttgcggtcgaaagttcgcagatcagagtggacttgcgcaccatactaagatccacctgagacagaaggacgctgcgcggggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 925 - DNA, 825 bp, Synthetic construct
  misc_feature 1..825: note = 3xFLAG-SV40 NLS--ZFP-SV40-NLS-KRAB (DNA Sequence)
  source 1..825: mol_type = other DNA
atggcaccgaagaaaaaacgcaaagttggtcgagtacccgctgccatggcggagcgccctttccagtgtaggatatgtatgcgcaacttcagtcagaacccagcccagtggcggcacatacggacgcatactggagaaaagccatttgcatgtgatatctgcgggcgaaaattcgcgcggtcagcagatttgagccggcatacgaagatccatacaggttcacaaaagccatttcaatgtcggatatgtatgcggaacttcagcacgtccggctcattgtcaagacatatacgaactcataccggagagaaacccttcgcgtgcgacatttgcggtcggaagttcgcgcgatccgaccatctgtcacgacatacgaaaatacacactggctctcaaaagccgtttcagtgcagaatttgcatgagaaattttagcaggagcgactcactccttcggcatatacgaacacacactggtgagaagccatttgcctgtgatatttgtggacgaaagtttgcgcaatcttacgataggtttcagcatacaaaaatccaccttcggcaaaaggacgcggcacggggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 926 - DNA, 825 bp, Synthetic construct
  misc_feature 1..825: note = 3xFLAG-SV40 NLS--ZFP-SV40-NLS-KRAB (DNA Sequence)
  source 1..825: mol_type = other DNA
atggcaccgaagaaaaaacgcaaagttggtcgagtacccgctgccatggctgaacgaccgtttcaatgtcgaatttgcatgcgcaacttctccacgtccgggtctctcagtagacacatcagaacgcatactggtgaaaaaccattcgcttgtgacatatgcggccgaaaattcgcgcggagcgaccacctgtcacggcataccaaaattcacaccgggagtcaaaaaccgttccagtgtaggatatgtatgcgcaacttcagccggtctgacagtctgcttcgacatattcggacgcacactggtgaaaagccgtttgcgtgcgacatttgtggtcgaaagttcgctcaatcttatgataggtttcaacacaccaaaatacatacgggctcccagaagccgttccagtgcagaatatgcatgagaaatttctctcgcagtgacaatttgtccacccatattcgaacgcacaccggcgagaaacccttcgcctgcgatatttgcggtcgcaagttcgcagacaacagggataggataaaacatacgaagatccatctgaggcaaaaagacgccgcccggggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 927 - DNA, 825 bp, Synthetic construct
  misc_feature 1..825: note = 3xFLAG-SV40 NLS--ZFP-SV40-NLS-KRAB (DNA Sequence)
  source 1..825: mol_type = other DNA
atggcaccgaagaaaaaacgcaaagttggtcgagtacccgcagccatggcagagcggccattccagtgcagaatctgcatgcggaacttttccgataggtccaatctgtcacgccatattaggacacacacgggtgaaaaaccgttcgcgtgtgacatatgcggtcgcaaattcgccctgagacagaacctgattatgcacacaaaaatacatacgggaagccagaaaccgttccagtgtcggatatgcatgaggaacttcagtgagagggggactttggcgaggcacatcaggactcacactggggagaagccctttgcatgtgatatctgtggccgaaaatttgctcgatcagatgctctcacccaacatacaaagatccatactggctctcaaaaaccgtttcaatgtagaatttgtatgcgcaacttctctcggtcagatagcctgtcccagcatatccgaactcatacaggtgagaaacccttcgcatgcgacatctgtgggcgaaaatttgctagaaaagcagaccggacccgacacacaaagattcatctgcgacaaaaagacgccgcccggggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 928 - DNA, 825 bp, Synthetic construct
  misc_feature 1..825: note = 3xFLAG-SV40 NLS--ZFP-SV40-NLS-KRAB (DNA Sequence)
  source 1..825: mol_type = other DNA
atggcaccgaagaaaaaacgcaaagttggtcgagtacccgcggccatggctgagaggccttttcaatgtagaatatgtatgcgaaatttttcacagtactgttgtctcacgaaccacataaggactcatacaggggagaaaccatttgcctgtgacatttgcggtcgcaaatttgctacttctggaaacctgactcggcacactaagattcacacagggtcccagaagcccttccagtgtcgcatttgcatgaggaattttagtcaaagctctgacttgtcaaggcatattcgcacgcacacgggcgaaaagccgttcgcttgcgacatatgcgggcggaaatttgccttccgctattatttgaagagacacaccaagatacatacgggctctcagaagccctttcagtgtaggatttgcatgcgcaatttttcacaatctggtgatctcacgcgacacatccggactcacacaggtgaaaagcctttcgcgtgcgacatttgcggccggaagtttgctgacaagggcaacctcacaaagcatacgaagattcacttgaggcagaaagatgctgctcggggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 929 - DNA, 825 bp, Synthetic construct
  misc_feature 1..825: note = 3xFLAG-SV40 NLS--ZFP-SV40-NLS-KRAB (DNA Sequence)
  source 1..825: mol_type = other DNA
atggcaccgaagaaaaaacgcaaagttggtcgagtacccgccgccatggccgaacgaccattccagtgcaggatatgtatgcgcaatttttcaaccagtggttcattgtcacgacatattagaacacacaccggtgagaaaccctttgcgtgtgacatctgtgggaggaaattcgcaagatctgacaaccttacgacacatacaaagattcacacaggctctcaaaagcccttccagtgccgaatttgcatgcgaaacttttcccagtctggtaatctcgctcgacatatcagaacccacacgggggaaaaaccattcgcttgtgatatttgcggacgaaagttcgccgacagaaccacactcatgagacacactaaaatccatactggtagtcagaagccgtttcagtgtagaatctgcatgaggaacttttcccagtcaggccaccttgcaagacatatacgaactcacactggagaaaagccgttcgcctgtgacatttgtgggcgcaagttcgcgcaactcacccatctgaatagccatacgaagattcacttgagacagaaagatgcggctcggggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 930 - DNA, 825 bp, Synthetic construct
  misc_feature 1..825: note = 3xFLAG-SV40 NLS--ZFP-SV40-NLS-KRAB (DNA Sequence)
  source 1..825: mol_type = other DNA
atggcaccgaagaaaaaacgcaaagttggtcgagtacccgcagctatggctgaacgcccattccagtgtcggatctgcatgcgcaacttttctataaaacacgatcttcaccgacacattcggacacatactggggagaagccctttgcgtgtgacatctgtggccgaaagttcgctagatccgcaaacttgactcggcatacgaaaattcacactggaagccagaaacctttccaatgtcgaatctgtatgaggaactttagcagaagtgataatctcgccaggcatatccgaacgcacacaggcgagaagccattcgcatgtgatatttgtggtagaaagttcgcccaaaatgtctctcgcccacgccatactaagatccacacgggctcccagaagccgttccaatgccgcatttgcatgcgaaacttttccagatcagacgatctgagcaagcatattaggacgcatacaggggagaagccttttgcttgcgacatttgcggccggaaatttgctgactcaagtcacagaacacggcataccaagatacaccttcgacaaaaagatgccgcacggggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 931 - DNA, 825 bp, Synthetic construct
  misc_feature 1..825: note = 3xFLAG-SV40 NLS--ZFP-SV40-NLS-KRAB (DNA Sequence)
  source 1..825: mol_type = other DNA
atggcaccgaagaaaaaacgcaaagttggtcgagtacccgcggccatggcggaacgaccctttcagtgccgaatttgcatgaggaacttttcacgatctgataacctggcgaggcacatccgaacacatacgggcgagaagccattcgcatgtgatatctgcgggcgaaagttcgcccaaaatgtcagtagaccgcgacatactaaaatacacactggctcacagaagccgttccaatgccgcatctgtatgcgcaatttttcccgaagcgacgatctgtctaaacatattcggacgcacactggggaaaagcctttcgcttgtgacatctgtgggaggaagttcgctgacagctctcataggacacgccatactaagattcataccggaagccagaagcctttccagtgtcggatttgcatgagaaactttagcacttctagcaacagaaagacacatatacgaacccatacgggtgagaaaccgttcgcatgcgatatctgtgggcgaaaatttgcagcccaatggaccagagcttgccataccaagatacaccttcggcagaaggacgctgcacggggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 932 - DNA, 825 bp, Synthetic construct
  misc_feature 1..825: note = 3xFLAG-SV40 NLS--ZFP-SV40-NLS-KRAB (DNA Sequence)
  source 1..825: mol_type = other DNA
atggcaccgaagaaaaaacgcaaagttggtcgagtacccgctgcgatggcagaacgaccttttcaatgccgaatttgtatgaggaacttttcccggtcagacgacctttccaagcacatcagaactcataccggagaaaaaccgttcgcctgtgacatttgtggacggaagtttgctgactcctctcacaggactcgccacactaagatacacaccggaagtcagaagcccttccaatgtaggatatgcatgagaaacttcagtacgtcatcaaaccgaaaaacgcatatcaggacacataccggcgaaaagccgtttgcatgtgatatctgcggcaggaaatttgcagctcagtggacacgggcatgtcacacaaaaatccataccggtagtcaaaaaccgtttcagtgtcgaatctgcatgaggaactttagccggaagcagacgagaaccacgcatataagaactcacacaggtgagaaaccctttgcgtgcgatatctgcggtcgcaaatttgctcaccgatcctccctgaggcgacatactaaaatacatctgcgacagaaagacgcggctcggggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 933 - DNA, 825 bp, Synthetic construct
  misc_feature 1..825: note = 3xFLAG-SV40 NLS--ZFP-SV40-NLS-KRAB (DNA Sequence)
  source 1..825: mol_type = other DNA
atggcaccgaagaaaaaacgcaaagttggtcgagtacccgccgccatggcagaacggccttttcagtgtcggatctgcatgagaaactttagtcagagtgcccatcgcaagaatcatattcgaactcataccggtgaaaaaccgttcgcgtgcgacatctgtggtcgaaagtttgccacatcatccaatagaaaaacgcatactaagattcataccggtagccagaaaccattccaatgtagaatctgcatgcgaaatttcagcaggagtgacaatttgtccgcacatatacggacacacacgggcgaaaaaccctttgcttgcgatatatgcggtagaaagttcgctaggaacaacgaccgaaaaacacacacgaagattcatacaggtagtcagaagccatttcaatgtcggatctgtatgcgaaatttctctacttctggcagcctgtcccggcacatcagaacacataccggtgagaagccatttgcatgtgacatatgtgggagaaaatttgcccaggcgggtcaccttgcgaagcatacaaagatccacctccgccagaaggacgccgcacggggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 934 - DNA, 825 bp, Synthetic construct
  misc_feature 1..825: note = 3xFLAG-SV40 NLS--ZFP-SV40-NLS-KRAB (DNA Sequence)
  source 1..825: mol_type = other DNA
atggcaccgaagaaaaaacgcaaagttggtcgagtacccgcggctatggcagagcggccattccaatgtaggatatgtatgaggaacttctcccggagcgatcacctgtcccaacacatccgcacgcatacgggtgagaagccgtttgcttgtgatatctgcggaagaaaatttgcagcatccagtacacgcacaaagcatacgaagattcatacgggatcccaaaagccctttcaatgcaggatttgtatgaggaacttcagtcggtccgacgatctgacacgacatattagaactcatactggagagaagccattcgcatgtgacatctgcggtaggaagttcgcgcagaaatctaacctgtcatctcacaccaagatacatacaggctcacagaagccgtttcaatgccgcatctgcatgaggaatttcagccagtccgcaaacagaactacgcatattcggacgcataccggcgagaagccgtttgcctgcgacatttgcgggaggaaattcgcacagaacgcgaccagaaccaaacacaccaaaatccatcttaggcaaaaggatgcggcccggggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 935 - DNA, 825 bp, Synthetic construct
  misc_feature 1..825: note = 3xFLAG-SV40 NLS--ZFP-SV40-NLS-KRAB (DNA Sequence)
  source 1..825: mol_type = other DNA
atggcaccgaagaaaaaacgcaaagttggtcgagtacccgcggccatggcagaacgaccctttcagtgccgaatttgcatgcggaactttagtcgcagtgacaccctgagcgagcatattcgcacgcatacgggagagaagccatttgcatgcgacatctgcggtagaaagtttgcgaggcgctggacgttggtaggccacacgaaaatccatacaggctcccagaaacccttccagtgcagaatttgtatgcgcaattttagtgacagaagtaacttgtcccgacatataaggacgcacaccggcgaaaaaccgtttgcctgtgatatctgtggtcggaaattcgcccagtccggtgacttgacacggcataccaaaatacacactggaagccaaaagccttttcagtgtcgcatatgtatgcgcaacttcagccagagtagtgacctttcacggcatatacggacgcatacgggtgagaaacccttcgcctgtgacatttgcgggcgaaagtttgcatatcattggtacctgaaaaaacatacgaaaatacatttgagacaaaaagatgcagcccggggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 936 - DNA, 825 bp, Synthetic construct
  misc_feature 1..825: note = 3xFLAG-SV40 NLS--ZFP-SV40-NLS-KRAB (DNA Sequence)
  source 1..825: mol_type = other DNA
atggcaccgaagaaaaaacgcaaagttggtcgagtacccgctgccatggccgagcgcccgtttcaatgcagaatatgtatgaggaacttctctagaagcgccaatcttgcgcgacacattagaactcacacaggcgagaaacctttcgcctgtgacatctgcggcagaaaatttgcgcgaagtgataacttgcgcgagcacacaaaaatccataccggttcccaaaagccctttcaatgtaggatttgcatgaggaacttttcaagaccatacacgctgagactccacattcgcacgcatacgggagaaaaaccatttgcttgtgacatatgcggccgaaagtttgcacaccgatccaacttgaataagcataccaaaatccatacggggtctcagaaacccttccagtgtcggatttgtatgcgaaacttctctcagagtggttctcttacgcgccacattagaacccacacgggggaaaagccattcgcgtgcgatatctgtggccggaaatttgctacttccgcaaatctttctcgacatacaaagatacatcttagacagaaggatgcggcacggggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 937 - DNA, 813 bp, Synthetic construct
  misc_feature 1..813: note = 3xFLAG-SV40 NLS--ZFP-SV40-NLS-KRAB (DNA Sequence)
  source 1..813: mol_type = other DNA
atggcaccgaagaaaaaacgcaaagttggtcgagtacccttggagcccggtgaaaaaccatatgcctgtccagagtgtggaaaaagttttagcagaagcgacgacctggttaggcatcaacgaactcacacaggggaaaagccgtacaaatgtcctgaatgcggaaagtcattctccacttcaggtagcctcgtgcgacatcagcgcacacatactggcgaaaaaccttataagtgtccggaatgcggcaagagtttttctagaagtgataagctcgtgcgacaccagcggacgcacacgggtgagaagccctacgcctgcccagagtgcggaaagtcctttagtaggtctgacgaactggtccggcaccaacgaacccatacaggggagaaaccctacaaatgtccagagtgcgggaaatcattttcaacgtctcacagcttgacggaacatcagaggacccatacaggcgaaaagccttacaaatgtccggagtgcggaaagtctttcagccgggctgataatctcacggagcaccaaagaacccacacgggtaagaaaacctctggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 938 - DNA, 813 bp, Synthetic construct
  misc_feature 1..813: note = 3xFLAG-SV40 NLS--ZFP-SV40-NLS-KRAB (DNA Sequence)
  source 1..813: mol_type = other DNA
atggcaccgaagaaaaaacgcaaagttggtcgagtacccttggagccgggagaaaagccatatgcctgtccggaatgcggcaaaagcttttcagaacggtcccatttgcgggaacatcagcgcacccataccggagaaaagccttacaagtgtcccgagtgtggtaagagcttttcaacttcccacagtctcactgaacatcagcgaactcacacaggcgaaaaaccatacaaatgcccggagtgtggaaagagtttttctcaagctgggcacttggccagccaccaaaggactcatacgggcgagaaaccgtatgcctgtccagaatgcgggaaatcattttctactagtcattcccttacggaacatcagagaacgcacaccggggagaagccatacaagtgtccggagtgcggaaaatcattctccgacccgggtcatctcgttcgccatcagaggactcatactggagagaaaccgtataaatgtcctgaatgcgggaagagcttttctacatctgggaaccttgtgcggcaccagcgaacccacacggggaaaaagacttctggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 939 - DNA, 813 bp, Synthetic construct
  misc_feature 1..813: note = 3xFLAG-SV40 NLS--ZFP-SV40-NLS-KRAB (DNA Sequence)
  source 1..813: mol_type = other DNA
atggcaccgaagaaaaaacgcaaagttggtcgagtacccctggaaccgggtgaaaaaccctacgcttgtcccgagtgtgggaaatcattctcaagggcagataatcttacggaacatcagcgcacacacaccggggaaaaaccctataagtgccctgagtgtggtaaatcattctctacgtcagggtcattggtgcgccatcagaggacccatacaggcgaaaaaccgtataagtgccccgaatgcggtaaaagcttcagcagaaaagataacttgaaaaatcaccaacgcactcacacgggagaaaaaccgtacgcatgcccggagtgcggcaagagtttcagtcagagtagctcacttgttcgccaccaaagaacccacacaggcgaaaagccctacaagtgtcctgaatgtggaaagagtttcagtcgaagtgataaattggttaggcaccaaagaacacacactggagagaaaccgtacaagtgtccagaatgtggcaagtctttttctgattctggaaatttgcgcgtccatcaaaggactcatactgggaaaaagacgtccggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 940 - DNA, 813 bp, Synthetic construct
  misc_feature 1..813: note = 3xFLAG-SV40 NLS--ZFP-SV40-NLS-KRAB (DNA Sequence)
  source 1..813: mol_type = other DNA
atggcaccgaagaaaaaacgcaaagttggtcgagtacccctcgaaccaggggaaaagccatacgcttgccccgagtgtggaaaatctttctctcagtcaagctcccttgtcagacaccagagaacccatacgggtgagaaaccatacaagtgcccagagtgcggcaaaagcttcagtcagagtggcgatctgcgccggcatcaaagaactcacactggagaaaagccctataagtgccccgaatgtggaaagagtttttccaggagtgacgaaagaaagagacaccagcggactcacaccggcgagaaaccatacgcatgccccgagtgcggaaaaagtttttcccaccgcacaacccttaccaatcatcaacgcacgcacacaggggagaaaccctacaagtgcccggagtgtggcaagtcattcagccgaagtgaccacctcactaaccaccaaaggactcacacaggagaaaaaccctacaaatgtccggagtgcggaaaatctttttccacgtccggtgagctggtccgccatcaacgaacccatactggtaaaaaaactagcggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 941 - DNA, 813 bp, Synthetic construct
  misc_feature 1..813: note = 3xFLAG-SV40 NLS--ZFP-SV40-NLS-KRAB (DNA Sequence)
  source 1..813: mol_type = other DNA
atggcaccgaagaaaaaacgcaaagttggtcgagtacccctggaacccggggagaagccgtacgcttgcccagagtgcggaaagagcttctctcagagcggagaccttagacgccaccagcgaacccacaccggcgaaaaaccgtataaatgcccggaatgcggcaagagttttagtcggtccgatgagcgaaagaggcatcaacgaacccatacgggagagaaaccctacaagtgccctgagtgtggtaagtcattttcccacagaacgacgttgacgaatcaccagagaacccatacgggtgagaaaccttacgcttgcccggagtgcggcaaaagcttcagccggagtgatcacttgaccaatcatcagaggacacacacgggtgagaagccctacaaatgtcccgaatgcggcaagtctttctcaacgtcaggcgaactcgtccggcaccagcgaacacatacgggagaaaagccgtacaaatgtccggaatgcggaaagtcattttcacggtcagatgacttggtgcgacaccagcgcactcacacaggcaagaagacctcaggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 942 - DNA, 813 bp, Synthetic construct
  misc_feature 1..813: note = 3xFLAG-SV40 NLS--ZFP-SV40-NLS-KRAB (DNA Sequence)
  source 1..813: mol_type = other DNA
atggcaccgaagaaaaaacgcaaagttggtcgagtacccctggagcctggtgagaagccgtatgcatgtcctgagtgtgggaagtcatttagtcagagggcccacttggaacgacaccaaaggacccacactggtgaaaaaccctacaaatgcccagagtgtggtaagtctttttcacagctggcccacctgagagcacaccagcgaactcatacgggcgagaaaccatacaagtgtccagagtgcggaaagtcattctcagatcccggccacttggtgcgacatcagagaacgcacacaggggagaagccttatgcttgcccggaatgcgggaagtctttcagccgccgaagtgcttgtcgaaggcaccaacggacccataccggtgagaaaccatataagtgcccagagtgtggaaagagttttagtcgatccgatcacctgactacgcaccagcggacgcacacaggagagaaaccgtataagtgccctgaatgcggtaagagcttctctcaatcaagctcactggttaggcaccaacgcactcataccggcaagaagacgtcaggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 943 - DNA, 813 bp, Synthetic construct
  misc_feature 1..813: note = 3xFLAG-SV40 NLS--ZFP-SV40-NLS-KRAB (DNA Sequence)
  source 1..813: mol_type = other DNA
atggcaccgaagaaaaaacgcaaagttggtcgagtaccccttgagccgggggaaaagccttatgcttgcccagagtgtggcaagagcttctcccaaagttcaaacctcgtccgacaccaaaggactcacacgggcgaaaaaccgtataaatgccccgagtgcggaaagtcattttccaggtccgacgatctggtccgccaccagcgcactcatacgggggaaaagccctataagtgccctgagtgcggcaagagcttctcaactcacctggatctcattcgccatcaacgcacacatacaggggagaagccttacgcttgtccagagtgcggcaagtctttcagtacgagcggaaacctgacggaacaccagcgaacccacacgggcgagaagccatataaatgtcccgaatgtggaaaatcattctctcgccgatctgcgtgccgccggcatcagaggacacataccggagaaaagccgtacaaatgccccgagtgtggaaaatcctttagcagaaatgatacacttaccgagcatcagaggacgcacactggaaaaaagacatctggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 944 - protein, 274 aa, Synthetic construct
  REGION 1..274: note = 3xFLAG-SV40 NLS--ZFP-SV40-NLS-KRAB fusion (AA Sequence)
MAPKKKRKVGRVPAAMAERPFQCRICMRNFSSEADRSRHIRTHTGEKPFACDICGRKFADRSNLTRHTKIHTGSQKPFQCRICMRNFSQSSDLSRHIRTHTGEKPFACDICGRKFAYHWYLKKHTKIHTGSQKPFQCRICMRNFSRSDSLSVHIRTHTGEKPFACDICGRKFAQNANRKTHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 945 - protein, 274 aa, Synthetic construct
  REGION 1..274: note = 3xFLAG-SV40 NLS--ZFP-SV40-NLS-KRAB fusion (AA Sequence)
MAPKKKRKVGRVPAAMAERPFQCRICMRNFSRSDVLSTHIRTHTGEKPFACDICGKKFADNSSRTRHTKIHTGSQKPFQCRICMRNFSRPYTLRLHIRTHTGEKPFACDICGRKFADSSHRTRHTKIHTGSQKPFQCRICMRNFSRSDHLSQHIRTHTGEKPFACDICGRKFADSSHRTRHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 946 - protein, 274 aa, Synthetic construct
  REGION 1..274: note = 3xFLAG-SV40 NLS--ZFP-SV40-NLS-KRAB fusion (AA Sequence)
MAPKKKRKVGRVPAAMAERPFQCRICMRNFSRSDHLSQHIRTHTGEKPFACDICGRKFAQSADRTKHTKIHTGSQKPFQCRICMRNFSRSDHLSQHIRTHTGEKPFACDICGRKFARRSDLKRHTKIHTGSQKPFQCRICMRNFSRSDHLSRHIRTHTGEKPFACDICGRKFAQSSDLRRHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 947 - protein, 274 aa, Synthetic construct
  REGION 1..274: note = 3xFLAG-SV40 NLS--ZFP-SV40-NLS-KRAB fusion (AA Sequence)
MAPKKKRKVGRVPAAMAERPFQCRICMRNFSRSDNLSEHIRTHTGEKPFACDICGRKFATSSNRKTHTKIHTGSQKPFQCRICMRNFSDRSHLTRHIRTHTGEKPFACDICGRKFARSDALTQHTKIHTGSQKPFQCRICMRNFSDRSALARHIRTHTGEKPFACDICGRKFARRFTLSKHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 948 - protein, 274 aa, Synthetic construct
  REGION 1..274: note = 3xFLAG-SV40 NLS--ZFP-SV40-NLS-KRAB fusion (AA Sequence)
MAPKKKRKVGRVPAAMAERPFQCRICMRNFSRSDHLSEHIRTHTGEKPFACDICGRKFAQYSGRYYHTKIHTGSQKPFQCRICMRNFSHGQTLNEHIRTHTGEKPFACDICGRKFAQSGNLARHTKIHTGSQKPFQCRICMRNFSRSDSLLRHIRTHTGEKPFACDICGRKFACREYRGKHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 949 - protein, 274 aa, Synthetic construct
  REGION 1..274: note = 3xFLAG-SV40 NLS--ZFP-SV40-NLS-KRAB fusion (AA Sequence)
MAPKKKRKVGRVPAAMAERPFQCRICMRNFSQSANRTTHIRTHTGEKPFACDICGRKFARSANLTRHTKIHTGSQKPFQCRICMRNFSRSDVLSEHIRTHTGEKPFACDICGRKFATSGHLSRHTKIHTGSQKPFQCRICMRNFSQSSDLSRHIRTHTGEKPFACDICGRKFAQWSTRKRHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 950 - protein, 274 aa, Synthetic construct
  REGION 1..274: note = 3xFLAG-SV40 NLS--ZFP-SV40-NLS-KRAB fusion (AA Sequence)
MAPKKKRKVGRVPAAMAERPFQCRICMRNFSQSGNLARHIRTHTGEKPFACDICGRKFAATCCLAHHTKIHTGSQKPFQCRICMRNFSRWQYLPTHIRTHAGEKPFACDICGRKFADRSALARHTKIHTGSQKPFQCRICMRNFSRSDNLSEHIRTHTGEKPFACDICGRKFAKRCNLRCHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 951 - protein, 274 aa, Synthetic construct
  REGION 1..274: note = 3xFLAG-SV40 NLS--ZFP-SV40-NLS-KRAB fusion (AA Sequence)
MAPKKKRKVGRVPAAMAERPFQCRICMRNFSNPANLTRHIRTHTGEKPFACDICGRKFAQNATRTKHTKIHTGSQKPFQCRICMRNFSQSGHLARHIRTHTGEKPFACDICGRKFANRHDRAKHTKIHTGSQKPFQCRICMRNFSRSDHLSEHIRTHTGEKPFACDICGRKFAQRRSRYKHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 952 - protein, 274 aa, Synthetic construct
  REGION 1..274: note = 3xFLAG-SV40 NLS--ZFP-SV40-NLS-KRAB fusion (AA Sequence)
MAPKKKRKVGRVPAAMAERPFQCRICMRNFSQSSDLSRHIRTHTGEKPFACDICGRKFAHRSTRNRHTKIHTGSQKPFQCRICMRNFSRSDVLSAHIRTHTGEKPFACDICGRKFADSRTRKNHTKIHTGSQKPFQCRICMRNFSQSGSLTRHIRTHTGEKPFACDICGRKFADQSGLAHHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 953 - protein, 274 aa, Synthetic construct
  REGION 1..274: note = 3xFLAG-SV40 NLS--ZFP-SV40-NLS-KRAB fusion (AA Sequence)
MAPKKKRKVGRVPAAMAERPFQCRICMRNFSQNPAQWRHIRTHTGEKPFACDICGRKFARSADLSRHTKIHTGSQKPFQCRICMRNFSTSGSLSRHIRTHTGEKPFACDICGRKFARSDHLSRHTKIHTGSQKPFQCRICMRNFSRSDSLLRHIRTHTGEKPFACDICGRKFAQSYDRFQHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 954 - protein, 274 aa, Synthetic construct
  REGION 1..274: note = 3xFLAG-SV40 NLS--ZFP-SV40-NLS-KRAB fusion (AA Sequence)
MAPKKKRKVGRVPAAMAERPFQCRICMRNFSTSGSLSRHIRTHTGEKPFACDICGRKFARSDHLSRHTKIHTGSQKPFQCRICMRNFSRSDSLLRHIRTHTGEKPFACDICGRKFAQSYDRFQHTKIHTGSQKPFQCRICMRNFSRSDNLSTHIRTHTGEKPFACDICGRKFADNRDRIKHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 955 - protein, 274 aa, Synthetic construct
  REGION 1..274: note = 3xFLAG-SV40 NLS--ZFP-SV40-NLS-KRAB fusion (AA Sequence)
MAPKKKRKVGRVPAAMAERPFQCRICMRNFSDRSNLSRHIRTHTGEKPFACDICGRKFALRQNLIMHTKIHTGSQKPFQCRICMRNFSERGTLARHIRTHTGEKPFACDICGRKFARSDALTQHTKIHTGSQKPFQCRICMRNFSRSDSLSQHIRTHTGEKPFACDICGRKFARKADRTRHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 956 - protein, 274 aa, Synthetic construct
  REGION 1..274: note = 3xFLAG-SV40 NLS--ZFP-SV40-NLS-KRAB fusion (AA Sequence)
MAPKKKRKVGRVPAAMAERPFQCRICMRNFSQYCCLTNHIRTHTGEKPFACDICGRKFATSGNLTRHTKIHTGSQKPFQCRICMRNFSQSSDLSRHIRTHTGEKPFACDICGRKFAFRYYLKRHTKIHTGSQKPFQCRICMRNFSQSGDLTRHIRTHTGEKPFACDICGRKFADKGNLTKHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 957 - protein, 274 aa, Synthetic construct
  REGION 1..274: note = 3xFLAG-SV40 NLS--ZFP-SV40-NLS-KRAB fusion (AA Sequence)
MAPKKKRKVGRVPAAMAERPFQCRICMRNFSTSGSLSRHIRTHTGEKPFACDICGRKFARSDNLTTHTKIHTGSQKPFQCRICMRNFSQSGNLARHIRTHTGEKPFACDICGRKFADRTTLMRHTKIHTGSQKPFQCRICMRNFSQSGHLARHIRTHTGEKPFACDICGRKFAQLTHLNSHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 958 - protein, 274 aa, Synthetic construct
  REGION 1..274: note = 3xFLAG-SV40 NLS--ZFP-SV40-NLS-KRAB fusion (AA Sequence)
MAPKKKRKVGRVPAAMAERPFQCRICMRNFSIKHDLHRHIRTHTGEKPFACDICGRKFARSANLTRHTKIHTGSQKPFQCRICMRNFSRSDNLARHIRTHTGEKPFACDICGRKFAQNVSRPRHTKIHTGSQKPFQCRICMRNFSRSDDLSKHIRTHTGEKPFACDICGRKFADSSHRTRHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 959 - protein, 274 aa, Synthetic construct
  REGION 1..274: note = 3xFLAG-SV40 NLS--ZFP-SV40-NLS-KRAB fusion (AA Sequence)
MAPKKKRKVGRVPAAMAERPFQCRICMRNFSRSDNLARHIRTHTGEKPFACDICGRKFAQNVSRPRHTKIHTGSQKPFQCRICMRNFSRSDDLSKHIRTHTGEKPFACDICGRKFADSSHRTRHTKIHTGSQKPFQCRICMRNFSTSSNRKTHIRTHTGEKPFACDICGRKFAAQWTRACHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 960 - protein, 274 aa, Synthetic construct
  REGION 1..274: note = 3xFLAG-SV40 NLS--ZFP-SV40-NLS-KRAB fusion (AA Sequence)
MAPKKKRKVGRVPAAMAERPFQCRICMRNFSRSDDLSKHIRTHTGEKPFACDICGRKFADSSHRTRHTKIHTGSQKPFQCRICMRNFSTSSNRKTHIRTHTGEKPFACDICGRKFAAQWTRACHTKIHTGSQKPFQCRICMRNFSRKQTRTTHIRTHTGEKPFACDICGRKFAHRSSLRRHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 961 - protein, 274 aa, Synthetic construct
  REGION 1..274: note = 3xFLAG-SV40 NLS--ZFP-SV40-NLS-KRAB fusion (AA Sequence)
MAPKKKRKVGRVPAAMAERPFQCRICMRNFSQSAHRKNHIRTHTGEKPFACDICGRKFATSSNRKTHTKIHTGSQKPFQCRICMRNFSRSDNLSAHIRTHTGEKPFACDICGRKFARNNDRKTHTKIHTGSQKPFQCRICMRNFSTSGSLSRHIRTHTGEKPFACDICGRKFAQAGHLAKHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 962 - protein, 274 aa, Synthetic construct
  REGION 1..274: note = 3xFLAG-SV40 NLS--ZFP-SV40-NLS-KRAB fusion (AA Sequence)
MAPKKKRKVGRVPAAMAERPFQCRICMRNFSRSDHLSQHIRTHTGEKPFACDICGRKFAASSTRTKHTKIHTGSQKPFQCRICMRNFSRSDDLTRHIRTHTGEKPFACDICGRKFAQKSNLSSHTKIHTGSQKPFQCRICMRNFSQSANRTTHIRTHTGEKPFACDICGRKFAQNATRTKHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 963 - protein, 274 aa, Synthetic construct
  REGION 1..274: note = 3xFLAG-SV40 NLS--ZFP-SV40-NLS-KRAB fusion (AA Sequence)
MAPKKKRKVGRVPAAMAERPFQCRICMRNFSRSDTLSEHIRTHTGEKPFACDICGRKFARRWTLVGHTKIHTGSQKPFQCRICMRNFSDRSNLSRHIRTHTGEKPFACDICGRKFAQSGDLTRHTKIHTGSQKPFQCRICMRNFSQSSDLSRHIRTHTGEKPFACDICGRKFAYHWYLKKHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 964 - protein, 274 aa, Synthetic construct
  REGION 1..274: note = 3xFLAG-SV40 NLS--ZFP-SV40-NLS-KRAB fusion (AA Sequence)
MAPKKKRKVGRVPAAMAERPFQCRICMRNFSRSANLARHIRTHTGEKPFACDICGRKFARSDNLREHTKIHTGSQKPFQCRICMRNFSRPYTLRLHIRTHTGEKPFACDICGRKFAHRSNLNKHTKIHTGSQKPFQCRICMRNFSQSGSLTRHIRTHTGEKPFACDICGRKFATSANLSRHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 965 - protein, 270 aa, Synthetic construct
  REGION 1..270: note = 3xFLAG-SV40 NLS--ZFP-SV40-NLS-KRAB fusion (AA Sequence)
MAPKKKRKVGRVPLEPGEKPYACPECGKSFSRSDDLVRHQRTHTGEKPYKCPECGKSFSTSGSLVRHQRTHTGEKPYKCPECGKSFSRSDKLVRHQRTHTGEKPYACPECGKSFSRSDELVRHQRTHTGEKPYKCPECGKSFSTSHSLTEHQRTHTGEKPYKCPECGKSFSRADNLTEHQRTHTGKKTSGSGPKKKRKVNGGGGSRTLVTFKDVFVDFTREEWKLLDTAQQIVYRNVMLENYKNLVSLGYQLTKPDVILRLEKGEEPWLV

SEQ ID NO: 966 - protein, 270 aa, Synthetic construct
  REGION 1..270: note = 3xFLAG-SV40 NLS--ZFP-SV40-NLS-KRAB fusion (AA Sequence)
MAPKKKRKVGRVPLEPGEKPYACPECGKSFSERSHLREHQRTHTGEKPYKCPECGKSFSTSHSLTEHQRTHTGEKPYKCPECGKSFSQAGHLASHQRTHTGEKPYACPECGKSFSTSHSLTEHQRTHTGEKPYKCPECGKSFSDPGHLVRHQRTHTGEKPYKCPECGKSFSTSGNLVRHQRTHTGKKTSGSGPKKKRKVNGGGGSRTLVTFKDVFVDFTREEWKLLDTAQQIVYRNVMLENYKNLVSLGYQLTKPDVILRLEKGEEPWLV

SEQ ID NO: 967 - protein, 270 aa, Synthetic construct
  REGION 1..270: note = 3xFLAG-SV40 NLS--ZFP-SV40-NLS-KRAB fusion (AA Sequence)
MAPKKKRKVGRVPLEPGEKPYKCPECGKSFSRADNLTEHQRTHTGEKPYKCPECGKSFSTSGSLVRHQRTHTGEKPYKCPECGKSFSRKDNLKNHQRTHTGEKPYKCPECGKSFSQSSSLVRHQRTHTGEKPYKCPECGKSFSRSDKLVRHQRTHTGEKPYKCPECGKSFSDSGNLRVHQRTHTGKKTSGSGPKKKRKVNGGGGSRTLVTFKDVFVDFTREEWKLLDTAQQIVYRNVMLENYKNLVSLGYQLTKPDVILRLEKGEEPWLV

SEQ ID NO: 968 - protein, 270 aa, Synthetic construct
  REGION 1..270: note = 3xFLAG-SV40 NLS--ZFP-SV40-NLS-KRAB fusion (AA Sequence)
MAPKKKRKVGRVPLEPGEKPYACPECGKSFSQSSSLVRHQRTHTGEKPYKCPECGKSFSQSGDLRRHQRTHTGEKPYKCPECGKSFSRSDERKRHQRTHTGEKPYACPECGKSFSHRTTLTNHQRTHTGEKPYKCPECGKSFSRSDHLTNHQRTHTGEKPYKCPECGKSFSTSGELVRHQRTHTGKKTSGSGPKKKRKVNGGGGSRTLVTFKDVFVDFTREEWKLLDTAQQIVYRNVMLENYKNLVSLGYQLTKPDVILRLEKGEEPWLV

SEQ ID NO: 969 - protein, 270 aa, Synthetic construct
  REGION 1..270: note = 3xFLAG-SV40 NLS--ZFP-SV40-NLS-KRAB fusion (AA Sequence)
MAPKKKRKVGRVPLEPGEKPYACPECGKSFSQSGDLRRHQRTHTGEKPYKCPECGKSFSRSDERKRHQRTHTGEKPYKCPECGKSFSHRTTLTNHQRTHTGEKPYACPECGKSFSRSDHLTNHQRTHTGEKPYKCPECGKSFSTSGELVRHQRTHTGEKPYKCPECGKSFSRSDDLVRHQRTHTGKKTSGSGPKKKRKVNGGGGSRTLVTFKDVFVDFTREEWKLLDTAQQIVYRNVMLENYKNLVSLGYQLTKPDVILRLEKGEEPWLV

SEQ ID NO: 970 - protein, 270 aa, Synthetic construct
  REGION 1..270: note = 3xFLAG-SV40 NLS--ZFP-SV40-NLS-KRAB fusion (AA Sequence)
MAPKKKRKVGRVPLEPGEKPYACPECGKSFSQRAHLERHQRTHTGEKPYKCPECGKSFSQLAHLRAHQRTHTGEKPYKCPECGKSFSDPGHLVRHQRTHTGEKPYACPECGKSFSRRSACRRHQRTHTGEKPYKCPECGKSFSRSDHLTTHQRTHTGEKPYKCPECGKSFSQSSSLVRHQRTHTGKKTSGSGPKKKRKVNGGGGSRTLVTFKDVFVDFTREEWKLLDTAQQIVYRNVMLENYKNLVSLGYQLTKPDVILRLEKGEEPWLV

SEQ ID NO: 971 - protein, 270 aa, Synthetic construct
  REGION 1..270: note = 3xFLAG-SV40 NLS--ZFP-SV40-NLS-KRAB fusion (AA Sequence)
MAPKKKRKVGRVPLEPGEKPYACPECGKSFSQSSNLVRHQRTHTGEKPYKCPECGKSFSRSDDLVRHQRTHTGEKPYKCPECGKSFSTHLDLIRHQRTHTGEKPYACPECGKSFSTSGNLTEHQRTHTGEKPYKCPECGKSFSRRSACRRHQRTHTGEKPYKCPECGKSFSRNDTLTEHQRTHTGKKTSGSGPKKKRKVNGGGGSRTLVTFKDVFVDFTREEWKLLDTAQQIVYRNVMLENYKNLVSLGYQLTKPDVILRLEKGEEPWLV

SEQ ID NO: 972 - DNA, 2690 bp, Synthetic construct
  misc_feature 1..2690: note = 3xFLAG-DNMT3AL-XTEN80-SV40 NLS-ZFP-SV40 NLS-KRAB (DNA sequence)
  source 1..2690: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgagctgctatggcagagcggccatttcagtgtcgaatttgcatgcgaaatttctctagcgaagcggatcgaagtagacatatccggacccatacgggtgagaaaccgttcgcgtgtgatatatgcggtcgcaaattcgcagaccgctccaacctgacaaggcacacaaaaattcatactggaagccagaaaccgtttcagtgccggatttgtatgcgcaatttctctcaatcctccgatctctcccgccacatcaggactcataccggggagaaaccctttgcttgtgacatttgtggcagaaagtttgcctatcactggtaccttaagaagcacaccaagatccatactggctctcaaaagcctttccaatgccgaatatgtatgcgaaacttttctaggtctgactccctctctgtacatatccgcactcacacgggtgaaaaaccatttgcctgtgacatatgtggcagaaaatttgctcaaaatgcgaaccgaaaaacgcatacgaaaatccatttgcgacaaaaagatgcagctcgggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 973 - DNA, 2690 bp, Synthetic construct
  misc_feature 1..2690: note = 3xFLAG-DNMT3AL-XTEN80-SV40 NLS-ZFP-SV40 NLS-KRAB (DNA sequence)
  source 1..2690: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgagcggcaatggcagaacgcccgtttcagtgtagaatctgcatgcgcaatttctccagaagtgacgtactcagcacgcatatcagaacacatactggtgaaaaaccgtttgcttgtgatatctgtggtaagaaattcgcggataactcctcaaggacgcggcatacgaagatccacactggttctcaaaagccgttccagtgccggatatgcatgcggaactttagtcggccatatacgcttcgacttcatattaggactcacaccggcgaaaagccgttcgcctgtgacatttgcgggagaaaattcgctgactctagtcaccgcacgaggcacactaaaatacatactggttcacaaaaaccattccagtgccgaatttgcatgcgaaatttttcccgaagtgaccatctctcacagcacatccgcacccatacaggggagaagcccttcgcttgtgatatatgcggacgcaagttcgcggacagctcacaccggacccgccatacaaagatccacttgagacagaaagatgcagcgcgggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 974 - DNA, 2690 bp, Synthetic construct
  misc_feature 1..2690: note = 3xFLAG-DNMT3AL-XTEN80-SV40 NLS-ZFP-SV40 NLS-KRAB (DNA sequence)
  source 1..2690: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgagccgcaatggccgaaagaccatttcagtgcaggatatgtatgcgcaacttctctcgcagtgaccacctgagtcaacatatcaggacacacacgggtgaaaagccttttgcatgcgatatttgtggtcgaaaatttgctcagtctgcggaccgaaccaagcacactaaaattcataccggctcacagaaaccgtttcaatgccgcatctgtatgaggaatttctctagatcagaccacttgtcccaacacatccggactcatactggagaaaagccgtttgcatgtgacatttgtggcaggaagtttgctagaaggtctgaccttaaaaggcacacaaaaattcatacgggttcccagaaaccatttcagtgccggatatgcatgcggaacttttcacgaagcgaccacctctcccgacatattcgaacgcacactggtgagaagccgtttgcttgcgacatttgcggacgcaagttcgctcagagctccgacttgaggaggcataccaagattcatctccggcagaaagatgccgcgcgggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 975 - DNA, 2690 bp, Synthetic construct
  misc_feature 1..2690: note = 3xFLAG-DNMT3AL-XTEN80-SV40 NLS-ZFP-SV40 NLS-KRAB (DNA sequence)
  source 1..2690: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgagccgcgatggctgagagaccatttcagtgtcgaatctgcatgagaaatttttcaaggagtgacaatctgtctgagcacatacgaacacatactggggaaaaaccctttgcatgtgacatttgtggaagaaagtttgctaccagctcaaatcgcaaaacacatacaaagatacataccggctcccaaaagccattccagtgccgcatctgcatgaggaacttttccgatcgctcacatcttacccgccacataagaactcacacaggcgaaaagccctttgcctgcgatatatgcggacggaagttcgcccgctccgacgctttgacccagcataccaaaatccatactgggtctcaaaagccatttcagtgccgaatctgtatgaggaatttctccgacaggtcagcattggcacggcatatccgcacccataccggtgagaagccttttgcttgcgatatctgtggacgaaaatttgcccggaggttcactctctccaaacacacaaagatacatctgcgccaaaaggatgcagcccgggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 976 - DNA, 2690 bp, Synthetic construct
  misc_feature 1..2690: note = 3xFLAG-DNMT3AL-XTEN80-SV40 NLS-ZFP-SV40 NLS-KRAB (DNA sequence)
  source 1..2690: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgagccgcaatggctgagcgcccgttccagtgcagaatatgcatgcggaatttttctaggtcagatcatttgtctgagcatattcgcacacacacgggagagaagccctttgcttgcgatatatgtggaaggaaattcgcgcaatacagtgggcgctactaccatacaaagatccatacgggctcccagaagcccttccaatgtcgaatatgtatgaggaattttagtcacggacaaacattgaatgaacatatacgcactcacactggtgaaaaaccatttgcgtgcgatatttgcggaaggaagtttgctcagtctgggaatttggcgcgacacaccaagatccacacaggatcccagaaaccatttcagtgcagaatttgtatgagaaactttagccgcagtgacagtctcttgaggcacatacggactcatactggggagaaaccattcgcctgcgatatttgtggacgaaagttcgcctgtcgcgagtacagaggcaagcacactaagatacatcttaggcaaaaggacgctgcacgggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 977 - DNA, 2690 bp, Synthetic construct
  misc_feature 1..2690: note = 3xFLAG-DNMT3AL-XTEN80-SV40 NLS-ZFP-SV40 NLS-KRAB (DNA sequence)
  source 1..2690: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgagccgcgatggctgagaggccttttcaatgtcgaatctgtatgaggaacttctctcaatctgctaatcgcacgacgcacattcgaacgcataccggtgagaagccattcgcgtgcgatatctgcggacggaaattcgcgaggtcagctaatcttacacggcacacgaagatccacacagggtcacagaaaccttttcagtgtcgcatttgcatgaggaatttctcccgatctgacgtccttagcgaacatatacgaactcacacgggcgagaagccatttgcgtgcgatatatgcgggaggaagtttgccacctctggacatctgagtcgacataccaaaattcataccggtagtcagaagccgttccaatgcagaatatgtatgcgaaatttctctcaaagctcagacttgtctaggcacataagaacgcacacgggtgaaaaacctttcgcgtgtgatatctgcggcagaaagttcgcacaatggtccacccgaaagcggcatacgaagattcacctcagacagaaagacgctgcccgggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 978 - DNA, 2690 bp, Synthetic construct
  misc_feature 1..2690: note = 3xFLAG-DNMT3AL-XTEN80-SV40 NLS-ZFP-SV40 NLS-KRAB (DNA sequence)
  source 1..2690: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgagcggcgatggcagaacgcccgttccaatgcagaatatgtatgagaaacttctcccagagcggaaatctggcacgccacatccggacacacacgggagagaagccatttgcttgtgacatttgtggtcgcaaatttgccgccacctgttgtctggcacatcatactaagatacatacggggtcacagaaaccattccaatgtaggatctgcatgcggaatttttctcggtggcagtatttgcctacgcatattagaacccacgccggtgagaaaccgtttgcatgtgacatctgcggacgaaagtttgccgatagatctgcgcttgctaggcatactaaaatccacacggggtcccagaagccttttcagtgtcggatatgtatgaggaacttcagtcgatcagacaaccttagcgagcatattcggacgcatactggagaaaaaccttttgcttgtgatatatgcggtaggaagttcgccaaacggtgtaaccttcgctgtcacaccaaaatacatcttcgccagaaagatgcggcccgggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 979 - DNA, 2690 bp, Synthetic construct
  misc_feature 1..2690: note = 3xFLAG-DNMT3AL-XTEN80-SV40 NLS-ZFP-SV40 NLS-KRAB (DNA sequence)
  source 1..2690: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgagccgctatggctgaaagaccattccagtgcagaatatgtatgaggaatttttctaatcccgcgaaccttacgcgccatatcaggacgcacacgggcgaaaagcccttcgcctgcgacatttgtgggagaaagtttgctcaaaacgcgaccaggacaaagcacacgaaaattcacactggtagccagaagccgttccagtgtaggatctgtatgcgcaatttctctcagtccgggcacctcgcgcgacacataagaactcatacgggggagaagccgtttgcatgtgacatctgcggccgcaagtttgcgaataggcatgacagggcaaaacatacgaagatccatacaggttctcaaaaacctttccaatgtcgaatatgcatgcgcaactttagtcggtcagaccacctttctgaacacatcaggacacacactggcgaaaagccgttcgcatgtgacatttgcggcagaaagttcgcacaaagacggtcccgctataagcacaccaaaattcaccttaggcaaaaggatgcagctcgggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 980 - DNA, 2690 bp, Synthetic construct
  misc_feature 1..2690: note = 3xFLAG-DNMT3AL-XTEN80-SV40 NLS-ZFP-SV40 NLS-KRAB (DNA sequence)
  source 1..2690: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgagcggcaatggcagaacgacccttccaatgccgcatatgtatgcgaaacttcagccagagctcagatctttccagacacatcaggactcacactggcgaaaaaccatttgcatgcgatatatgcgggagaaaattcgcgcaccgcagtacgcgaaacaggcatacaaagatacatactggcagtcaaaagccatttcaatgtcgaatatgcatgaggaactttagtcgatctgacgtgctgagcgctcacatacggacccataccggagagaaaccattcgcttgtgacatctgtggtaggaagttcgcggattcccggacccgcaaaaatcatactaaaattcacactgggtctcagaagccctttcagtgtaggatatgtatgcgcaattttagccagagtggttcattgactcggcatatcagaacacatactggagagaaacctttcgcgtgtgatatttgcggtcgaaagttcgcagatcagagtggacttgcgcaccatactaagatccacctgagacagaaggacgctgcgcgggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 981 - DNA, 2690 bp, Synthetic construct
  misc_feature 1..2690: note = 3xFLAG-DNMT3AL-XTEN80-SV40 NLS-ZFP-SV40 NLS-KRAB (DNA sequence)
  source 1..2690: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgagctgccatggcggagcgccctttccagtgtaggatatgtatgcgcaacttcagtcagaacccagcccagtggcggcacatacggacgcatactggagaaaagccatttgcatgtgatatctgcgggcgaaaattcgcgcggtcagcagatttgagccggcatacgaagatccatacaggttcacaaaagccatttcaatgtcggatatgtatgcggaacttcagcacgtccggctcattgtcaagacatatacgaactcataccggagagaaacccttcgcgtgcgacatttgcggtcggaagttcgcgcgatccgaccatctgtcacgacatacgaaaatacacactggctctcaaaagccgtttcagtgcagaatttgcatgagaaattttagcaggagcgactcactccttcggcatatacgaacacacactggtgagaagccatttgcctgtgatatttgtggacgaaagtttgcgcaatcttacgataggtttcagcatacaaaaatccaccttcggcaaaaggacgcggcacgggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 982 - DNA, 2690 bp, Synthetic construct
  misc_feature 1..2690: note = 3xFLAG-DNMT3AL-XTEN80-SV40 NLS-ZFP-SV40 NLS-KRAB (DNA sequence)
  source 1..2690: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgagctgccatggctgaacgaccgtttcaatgtcgaatttgcatgcgcaacttctccacgtccgggtctctcagtagacacatcagaacgcatactggtgaaaaaccattcgcttgtgacatatgcggccgaaaattcgcgcggagcgaccacctgtcacggcataccaaaattcacaccgggagtcaaaaaccgttccagtgtaggatatgtatgcgcaacttcagccggtctgacagtctgcttcgacatattcggacgcacactggtgaaaagccgtttgcgtgcgacatttgtggtcgaaagttcgctcaatcttatgataggtttcaacacaccaaaatacatacgggctcccagaagccgttccagtgcagaatatgcatgagaaatttctctcgcagtgacaatttgtccacccatattcgaacgcacaccggcgagaaacccttcgcctgcgatatttgcggtcgcaagttcgcagacaacagggataggataaaacatacgaagatccatctgaggcaaaaagacgccgcccgggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 983 - DNA, 2690 bp, Synthetic construct
  misc_feature 1..2690: note = 3xFLAG-DNMT3AL-XTEN80-SV40 NLS-ZFP-SV40 NLS-KRAB (DNA sequence)
  source 1..2690: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgagcagccatggcagagcggccattccagtgcagaatctgcatgcggaacttttccgataggtccaatctgtcacgccatattaggacacacacgggtgaaaaaccgttcgcgtgtgacatatgcggtcgcaaattcgccctgagacagaacctgattatgcacacaaaaatacatacgggaagccagaaaccgttccagtgtcggatatgcatgaggaacttcagtgagagggggactttggcgaggcacatcaggactcacactggggagaagccctttgcatgtgatatctgtggccgaaaatttgctcgatcagatgctctcacccaacatacaaagatccatactggctctcaaaaaccgtttcaatgtagaatttgtatgcgcaacttctctcggtcagatagcctgtcccagcatatccgaactcatacaggtgagaaacccttcgcatgcgacatctgtgggcgaaaatttgctagaaaagcagaccggacccgacacacaaagattcatctgcgacaaaaagacgccgcccgggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 984 - DNA, 2690 bp, Synthetic construct
  misc_feature 1..2690: note = 3xFLAG-DNMT3AL-XTEN80-SV40 NLS-ZFP-SV40 NLS-KRAB (DNA sequence)
  source 1..2690: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgagcggccatggctgagaggccttttcaatgtagaatatgtatgcgaaatttttcacagtactgttgtctcacgaaccacataaggactcatacaggggagaaaccatttgcctgtgacatttgcggtcgcaaatttgctacttctggaaacctgactcggcacactaagattcacacagggtcccagaagcccttccagtgtcgcatttgcatgaggaattttagtcaaagctctgacttgtcaaggcatattcgcacgcacacgggcgaaaagccgttcgcttgcgacatatgcgggcggaaatttgccttccgctattatttgaagagacacaccaagatacatacgggctctcagaagccctttcagtgtaggatttgcatgcgcaatttttcacaatctggtgatctcacgcgacacatccggactcacacaggtgaaaagcctttcgcgtgcgacatttgcggccggaagtttgctgacaagggcaacctcacaaagcatacgaagattcacttgaggcagaaagatgctgctcgggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 985 - DNA, 2690 bp, Synthetic construct
  misc_feature 1..2690: note = 3xFLAG-DNMT3AL-XTEN80-SV40 NLS-ZFP-SV40 NLS-KRAB (DNA sequence)
  source 1..2690: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgagccgccatggccgaacgaccattccagtgcaggatatgtatgcgcaatttttcaaccagtggttcattgtcacgacatattagaacacacaccggtgagaaaccctttgcgtgtgacatctgtgggaggaaattcgcaagatctgacaaccttacgacacatacaaagattcacacaggctctcaaaagcccttccagtgccgaatttgcatgcgaaacttttcccagtctggtaatctcgctcgacatatcagaacccacacgggggaaaaaccattcgcttgtgatatttgcggacgaaagttcgccgacagaaccacactcatgagacacactaaaatccatactggtagtcagaagccgtttcagtgtagaatctgcatgaggaacttttcccagtcaggccaccttgcaagacatatacgaactcacactggagaaaagccgttcgcctgtgacatttgtgggcgcaagttcgcgcaactcacccatctgaatagccatacgaagattcacttgagacagaaagatgcggctcgggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 986 - DNA, 2690 bp, Synthetic construct
  misc_feature 1..2690: note = 3xFLAG-DNMT3AL-XTEN80-SV40 NLS-ZFP-SV40 NLS-KRAB (DNA sequence)
  source 1..2690: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgagcagctatggctgaacgcccattccagtgtcggatctgcatgcgcaacttttctataaaacacgatcttcaccgacacattcggacacatactggggagaagccctttgcgtgtgacatctgtggccgaaagttcgctagatccgcaaacttgactcggcatacgaaaattcacactggaagccagaaacctttccaatgtcgaatctgtatgaggaactttagcagaagtgataatctcgccaggcatatccgaacgcacacaggcgagaagccattcgcatgtgatatttgtggtagaaagttcgcccaaaatgtctctcgcccacgccatactaagatccacacgggctcccagaagccgttccaatgccgcatttgcatgcgaaacttttccagatcagacgatctgagcaagcatattaggacgcatacaggggagaagccttttgcttgcgacatttgcggccggaaatttgctgactcaagtcacagaacacggcataccaagatacaccttcgacaaaaagatgccgcacgggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 987 - DNA, 2690 bp, Synthetic construct
  misc_feature 1..2690: note = 3xFLAG-DNMT3AL-XTEN80-SV40 NLS-ZFP-SV40 NLS-KRAB (DNA sequence)
  source 1..2690: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgagcggccatggcggaacgaccctttcagtgccgaatttgcatgaggaacttttcacgatctgataacctggcgaggcacatccgaacacatacgggcgagaagccattcgcatgtgatatctgcgggcgaaagttcgcccaaaatgtcagtagaccgcgacatactaaaatacacactggctcacagaagccgttccaatgccgcatctgtatgcgcaatttttcccgaagcgacgatctgtctaaacatattcggacgcacactggggaaaagcctttcgcttgtgacatctgtgggaggaagttcgctgacagctctcataggacacgccatactaagattcataccggaagccagaagcctttccagtgtcggatttgcatgagaaactttagcacttctagcaacagaaagacacatatacgaacccatacgggtgagaaaccgttcgcatgcgatatctgtgggcgaaaatttgcagcccaatggaccagagcttgccataccaagatacaccttcggcagaaggacgctgcacgggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 988 - DNA, 2690 bp, Synthetic construct
  misc_feature 1..2690: note = 3xFLAG-DNMT3AL-XTEN80-SV40 NLS-ZFP-SV40 NLS-KRAB (DNA sequence)
  source 1..2690: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgagctgcgatggcagaacgaccttttcaatgccgaatttgtatgaggaacttttcccggtcagacgacctttccaagcacatcagaactcataccggagaaaaaccgttcgcctgtgacatttgtggacggaagtttgctgactcctctcacaggactcgccacactaagatacacaccggaagtcagaagcccttccaatgtaggatatgcatgagaaacttcagtacgtcatcaaaccgaaaaacgcatatcaggacacataccggcgaaaagccgtttgcatgtgatatctgcggcaggaaatttgcagctcagtggacacgggcatgtcacacaaaaatccataccggtagtcaaaaaccgtttcagtgtcgaatctgcatgaggaactttagccggaagcagacgagaaccacgcatataagaactcacacaggtgagaaaccctttgcgtgcgatatctgcggtcgcaaatttgctcaccgatcctccctgaggcgacatactaaaatacatctgcgacagaaagacgcggctcgggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 989 - DNA, 2690 bp, Synthetic construct
  misc_feature 1..2690: note = 3xFLAG-DNMT3AL-XTEN80-SV40 NLS-ZFP-SV40 NLS-KRAB (DNA sequence)
  source 1..2690: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgagccgccatggcagaacggccttttcagtgtcggatctgcatgagaaactttagtcagagtgcccatcgcaagaatcatattcgaactcataccggtgaaaaaccgttcgcgtgcgacatctgtggtcgaaagtttgccacatcatccaatagaaaaacgcatactaagattcataccggtagccagaaaccattccaatgtagaatctgcatgcgaaatttcagcaggagtgacaatttgtccgcacatatacggacacacacgggcgaaaaaccctttgcttgcgatatatgcggtagaaagttcgctaggaacaacgaccgaaaaacacacacgaagattcatacaggtagtcagaagccatttcaatgtcggatctgtatgcgaaatttctctacttctggcagcctgtcccggcacatcagaacacataccggtgagaagccatttgcatgtgacatatgtgggagaaaatttgcccaggcgggtcaccttgcgaagcatacaaagatccacctccgccagaaggacgccgcacgggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 990 - DNA, 2690 bp, Synthetic construct
  misc_feature 1..2690: note = 3xFLAG-DNMT3AL-XTEN80-SV40 NLS-ZFP-SV40 NLS-KRAB (DNA sequence)
  source 1..2690: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgagcggctatggcagagcggccattccaatgtaggatatgtatgaggaacttctcccggagcgatcacctgtcccaacacatccgcacgcatacgggtgagaagccgtttgcttgtgatatctgcggaagaaaatttgcagcatccagtacacgcacaaagcatacgaagattcatacgggatcccaaaagccctttcaatgcaggatttgtatgaggaacttcagtcggtccgacgatctgacacgacatattagaactcatactggagagaagccattcgcatgtgacatctgcggtaggaagttcgcgcagaaatctaacctgtcatctcacaccaagatacatacaggctcacagaagccgtttcaatgccgcatctgcatgaggaatttcagccagtccgcaaacagaactacgcatattcggacgcataccggcgagaagccgtttgcctgcgacatttgcgggaggaaattcgcacagaacgcgaccagaaccaaacacaccaaaatccatcttaggcaaaaggatgcggcccgggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 991 - DNA, 2690 bp, Synthetic construct
  misc_feature 1..2690: note = 3xFLAG-DNMT3AL-XTEN80-SV40 NLS-ZFP-SV40 NLS-KRAB (DNA sequence)
  source 1..2690: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgagcggccatggcagaacgaccctttcagtgccgaatttgcatgcggaactttagtcgcagtgacaccctgagcgagcatattcgcacgcatacgggagagaagccatttgcatgcgacatctgcggtagaaagtttgcgaggcgctggacgttggtaggccacacgaaaatccatacaggctcccagaaacccttccagtgcagaatttgtatgcgcaattttagtgacagaagtaacttgtcccgacatataaggacgcacaccggcgaaaaaccgtttgcctgtgatatctgtggtcggaaattcgcccagtccggtgacttgacacggcataccaaaatacacactggaagccaaaagccttttcagtgtcgcatatgtatgcgcaacttcagccagagtagtgacctttcacggcatatacggacgcatacgggtgagaaacccttcgcctgtgacatttgcgggcgaaagtttgcatatcattggtacctgaaaaaacatacgaaaatacatttgagacaaaaagatgcagcccgggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 992 - DNA, 2690 bp, Synthetic construct
  misc_feature 1..2690: note = 3xFLAG-DNMT3AL-XTEN80-SV40 NLS-ZFP-SV40 NLS-KRAB (DNA sequence)
  source 1..2690: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgagctgccatggccgagcgcccgtttcaatgcagaatatgtatgaggaacttctctagaagcgccaatcttgcgcgacacattagaactcacacaggcgagaaacctttcgcctgtgacatctgcggcagaaaatttgcgcgaagtgataacttgcgcgagcacacaaaaatccataccggttcccaaaagccctttcaatgtaggatttgcatgaggaacttttcaagaccatacacgctgagactccacattcgcacgcatacgggagaaaaaccatttgcttgtgacatatgcggccgaaagtttgcacaccgatccaacttgaataagcataccaaaatccatacggggtctcagaaacccttccagtgtcggatttgtatgcgaaacttctctcagagtggttctcttacgcgccacattagaacccacacgggggaaaagccattcgcgtgcgatatctgtggccggaaatttgctacttccgcaaatctttctcgacatacaaagatacatcttagacagaaggatgcggcacgggctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 993 - DNA, 2678 bp, Synthetic construct
  misc_feature 1..2678: note = 3xFLAG-DNMT3AL-XTEN80-SV40 NLS-ZFP-SV40 NLS-KRAB (DNA sequence)
  source 1..2678: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgattggagcccggtgaaaaaccatatgcctgtccagagtgtggaaaaagttttagcagaagcgacgacctggttaggcatcaacgaactcacacaggggaaaagccgtacaaatgtcctgaatgcggaaagtcattctccacttcaggtagcctcgtgcgacatcagcgcacacatactggcgaaaaaccttataagtgtccggaatgcggcaagagtttttctagaagtgataagctcgtgcgacaccagcggacgcacacgggtgagaagccctacgcctgcccagagtgcggaaagtcctttagtaggtctgacgaactggtccggcaccaacgaacccatacaggggagaaaccctacaaatgtccagagtgcgggaaatcattttcaacgtctcacagcttgacggaacatcagaggacccatacaggcgaaaagccttacaaatgtccggagtgcggaaagtctttcagccgggctgataatctcacggagcaccaaagaacccacacgggtaagaaaacctctgctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 994 - DNA, 2678 bp, Synthetic construct
  misc_feature 1..2678: note = 3xFLAG-DNMT3AL-XTEN80-SV40 NLS-ZFP-SV40 NLS-KRAB (DNA sequence)
  source 1..2678: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgattggagccgggagaaaagccatatgcctgtccggaatgcggcaaaagcttttcagaacggtcccatttgcgggaacatcagcgcacccataccggagaaaagccttacaagtgtcccgagtgtggtaagagcttttcaacttcccacagtctcactgaacatcagcgaactcacacaggcgaaaaaccatacaaatgcccggagtgtggaaagagtttttctcaagctgggcacttggccagccaccaaaggactcatacgggcgagaaaccgtatgcctgtccagaatgcgggaaatcattttctactagtcattcccttacggaacatcagagaacgcacaccggggagaagccatacaagtgtccggagtgcggaaaatcattctccgacccgggtcatctcgttcgccatcagaggactcatactggagagaaaccgtataaatgtcctgaatgcgggaagagcttttctacatctgggaaccttgtgcggcaccagcgaacccacacggggaaaaagacttctgctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 995 - DNA, 2678 bp, Synthetic construct
  misc_feature 1..2678: note = 3xFLAG-DNMT3AL-XTEN80-SV40 NLS-ZFP-SV40 NLS-KRAB (DNA sequence)
  source 1..2678: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgactggaaccgggtgaaaaaccctacgcttgtcccgagtgtgggaaatcattctcaagggcagataatcttacggaacatcagcgcacacacaccggggaaaaaccctataagtgccctgagtgtggtaaatcattctctacgtcagggtcattggtgcgccatcagaggacccatacaggcgaaaaaccgtataagtgccccgaatgcggtaaaagcttcagcagaaaagataacttgaaaaatcaccaacgcactcacacgggagaaaaaccgtacgcatgcccggagtgcggcaagagtttcagtcagagtagctcacttgttcgccaccaaagaacccacacaggcgaaaagccctacaagtgtcctgaatgtggaaagagtttcagtcgaagtgataaattggttaggcaccaaagaacacacactggagagaaaccgtacaagtgtccagaatgtggcaagtctttttctgattctggaaatttgcgcgtccatcaaaggactcatactgggaaaaagacgtccgctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 996 - DNA, 2678 bp, Synthetic construct
  misc_feature 1..2678: note = 3xFLAG-DNMT3AL-XTEN80-SV40 NLS-ZFP-SV40 NLS-KRAB (DNA sequence)
  source 1..2678: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgactcgaaccaggggaaaagccatacgcttgccccgagtgtggaaaatctttctctcagtcaagctcccttgtcagacaccagagaacccatacgggtgagaaaccatacaagtgcccagagtgcggcaaaagcttcagtcagagtggcgatctgcgccggcatcaaagaactcacactggagaaaagccctataagtgccccgaatgtggaaagagtttttccaggagtgacgaaagaaagagacaccagcggactcacaccggcgagaaaccatacgcatgccccgagtgcggaaaaagtttttcccaccgcacaacccttaccaatcatcaacgcacgcacacaggggagaaaccctacaagtgcccggagtgtggcaagtcattcagccgaagtgaccacctcactaaccaccaaaggactcacacaggagaaaaaccctacaaatgtccggagtgcggaaaatctttttccacgtccggtgagctggtccgccatcaacgaacccatactggtaaaaaaactagcgctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 997 - DNA, 2678 bp, Synthetic construct
  misc_feature 1..2678: note = 3xFLAG-DNMT3AL-XTEN80-SV40 NLS-ZFP-SV40 NLS-KRAB (DNA sequence)
  source 1..2678: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgactggaacccggggagaagccgtacgcttgcccagagtgcggaaagagcttctctcagagcggagaccttagacgccaccagcgaacccacaccggcgaaaaaccgtataaatgcccggaatgcggcaagagttttagtcggtccgatgagcgaaagaggcatcaacgaacccatacgggagagaaaccctacaagtgccctgagtgtggtaagtcattttcccacagaacgacgttgacgaatcaccagagaacccatacgggtgagaaaccttacgcttgcccggagtgcggcaaaagcttcagccggagtgatcacttgaccaatcatcagaggacacacacgggtgagaagccctacaaatgtcccgaatgcggcaagtctttctcaacgtcaggcgaactcgtccggcaccagcgaacacatacgggagaaaagccgtacaaatgtccggaatgcggaaagtcattttcacggtcagatgacttggtgcgacaccagcgcactcacacaggcaagaagacctcagctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 998 - DNA, 2678 bp, Synthetic construct
  misc_feature 1..2678: note = 3xFLAG-DNMT3AL-XTEN80-SV40 NLS-ZFP-SV40 NLS-KRAB (DNA sequence)
  source 1..2678: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgactggagcctggtgagaagccgtatgcatgtcctgagtgtgggaagtcatttagtcagagggcccacttggaacgacaccaaaggacccacactggtgaaaaaccctacaaatgcccagagtgtggtaagtctttttcacagctggcccacctgagagcacaccagcgaactcatacgggcgagaaaccatacaagtgtccagagtgcggaaagtcattctcagatcccggccacttggtgcgacatcagagaacgcacacaggggagaagccttatgcttgcccggaatgcgggaagtctttcagccgccgaagtgcttgtcgaaggcaccaacggacccataccggtgagaaaccatataagtgcccagagtgtggaaagagttttagtcgatccgatcacctgactacgcaccagcggacgcacacaggagagaaaccgtataagtgccctgaatgcggtaagagcttctctcaatcaagctcactggttaggcaccaacgcactcataccggcaagaagacgtcagctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 999 - DNA, 2678 bp, Synthetic construct
  misc_feature 1..2678: note = 3xFLAG-DNMT3AL-XTEN80-SV40 NLS-ZFP-SV40 NLS-KRAB (DNA sequence)
  source 1..2678: mol_type = other DNA
atgcacgatcaggagtttgacccccctaaggtgtacccacccgtgccagccgagaagaggaagcccatccgcgtgctgtccctgttcgacggcatcgccacaggcctgctggtgctgaaggatctgggcatccaggtggacagatatatcgcctccgaggtgtgcgaggattctatcaccgtgggcatggtgaggcaccagggcaagatcatgtacgtgggcgacgtgcgcagcgtgacacagaagcacatccaggagtggggacccttcgacctggtcatcggaggcagcccctgtaatgacctgtccatcgtgaaccctgcaaggaagggcctgtatgagggaaccggcagactgttctttgagttctacaggctgctgcacgacgcccgccctaaggagggcgatgacaggccattcttttggctgtttgagaacgtggtggccatgggcgtgagcgacaagcgggatatctccagattcctggagtctaatcccgtgatgatcgatgcaaaggaggtgtctgccgcacacagggcaaggtacttttggggaaatctgcctggcatgaaccgcccactggccagcaccgtgaacgacaagctggagctgcaggagtgcctggagcacggaaggatcgccaagttctccaaggtgcggacaatcaccacaagatctaacagcatcaagcagggcaaggatcagcacttccccgtgttcatgaatgagaaggaggacatcctgtggtgtaccgagatggagcgcgtgttcggctttccagtgcactatacagacgtgagcaatatgagccggctggcaaggcagagactgctgggccggtcctggtctgtgccagtgatcagacacctgttcgcccccctgaaggagtactttgcctgcgtgtctagcggcaactctaatgccaacagcagaggcccttccttttcctctggcctggtgccactgtctctgaggggcagccacatgggccccatggagatctacaagaccgtgtccgcctggaagaggcagcctgtgcgcgtgctgtctctgttccgcaacatcgacaaggtgctgaagagcctgggctttctggagagcggatccggatctggaggaggcaccctgaagtatgtggaggatgtgacaaatgtggtgcggagagatgtggagaagtggggccccttcgatctggtgtacggatccacccagccactgggaagctcctgcgataggtgtccaggatggtatatgttccagtttcacagaatcctgcagtacgcactgccaaggcaggagagccagcgccctttcttttggatctttatggacaacctgctgctgacagaggatgaccaggagacaacaacccgcttcctgcagacagaggcagtgaccctgcaggatgtgaggggacgcgactatcagaatgccatgcgggtgtggtctaacatccctggcctgaagagcaagcacgcccccctgacccctaaggaggaggagtacctgcaggcccaggtgcggagcagatccaagctggatgcccctaaggtggacctgctggtgaagaattgtctgctgccactgcgggagtacttcaagtactttagtcagaatagcctgccactgggtggacctagctctggagccccgcctccgtcaggtggatctcctgcaggtagcccaacttccacggaagagggcacgtctgagagtgcgactcctgagagcgggcctggcacaagtactgagcccagcgaaggttctgcacccgggtctccagctgggagccctacctcaacagaggaaggtaccagcacagagccttctgagggtagcgctcctggcacgtccaccgaaccgtccgaggggatggcaccgaagaaaaaacgcaaagttggtcgacttgagccgggggaaaagccttatgcttgcccagagtgtggcaagagcttctcccaaagttcaaacctcgtccgacaccaaaggactcacacgggcgaaaaaccgtataaatgccccgagtgcggaaagtcattttccaggtccgacgatctggtccgccaccagcgcactcatacgggggaaaagccctataagtgccctgagtgcggcaagagcttctcaactcacctggatctcattcgccatcaacgcacacatacaggggagaagccttacgcttgtccagagtgcggcaagtctttcagtacgagcggaaacctgacggaacaccagcgaacccacacgggcgagaagccatataaatgtcccgaatgtggaaaatcattctctcgccgatctgcgtgccgccggcatcagaggacacataccggagaaaagccgtacaaatgccccgagtgtggaaaatcctttagcagaaatgatacacttaccgagcatcagaggacgcacactggaaaaaagacatctgctccggaccgaaaaaaaagagaaaggtaaacggcgggggaggatcacggaccctggttacatttaaggacgtttttgtagacttcacgagggaggaatggaagctgttggacaccgcccagcaaatcgtgtatcgaaatgtaatgttggaaaattataaaaatctggtttccctcggctaccaattgacaaaaccagacgtcatcctcagactggaaaaaggggaagaaccttggcttgtctga

SEQ ID NO: 1000 - protein, 898 aa, Synthetic construct
  REGION 1..898: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPAAMAERPFQCRICMRNFSSEADRSRHIRTHTGEKPFACDICGRKFADRSNLTRHTKIHTGSQKPFQCRICMRNFSQSSDLSRHIRTHTGEKPFACDICGRKFAYHWYLKKHTKIHTGSQKPFQCRICMRNFSRSDSLSVHIRTHTGEKPFACDICGRKFAQNANRKTHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1001 - protein, 898 aa, Synthetic construct
  REGION 1..898: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPAAMAERPFQCRICMRNFSRSDVLSTHIRTHTGEKPFACDICGKKFADNSSRTRHTKIHTGSQKPFQCRICMRNFSRPYTLRLHIRTHTGEKPFACDICGRKFADSSHRTRHTKIHTGSQKPFQCRICMRNFSRSDHLSQHIRTHTGEKPFACDICGRKFADSSHRTRHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1002 - protein, 898 aa, Synthetic construct
  REGION 1..898: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPAAMAERPFQCRICMRNFSRSDHLSQHIRTHTGEKPFACDICGRKFAQSADRTKHTKIHTGSQKPFQCRICMRNFSRSDHLSQHIRTHTGEKPFACDICGRKFARRSDLKRHTKIHTGSQKPFQCRICMRNFSRSDHLSRHIRTHTGEKPFACDICGRKFAQSSDLRRHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1003 - protein, 898 aa, Synthetic construct
  REGION 1..898: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPAAMAERPFQCRICMRNFSRSDNLSEHIRTHTGEKPFACDICGRKFATSSNRKTHTKIHTGSQKPFQCRICMRNFSDRSHLTRHIRTHTGEKPFACDICGRKFARSDALTQHTKIHTGSQKPFQCRICMRNFSDRSALARHIRTHTGEKPFACDICGRKFARRFTLSKHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1004 - protein, 898 aa, Synthetic construct
  REGION 1..898: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPAAMAERPFQCRICMRNFSRSDHLSEHIRTHTGEKPFACDICGRKFAQYSGRYYHTKIHTGSQKPFQCRICMRNFSHGQTLNEHIRTHTGEKPFACDICGRKFAQSGNLARHTKIHTGSQKPFQCRICMRNFSRSDSLLRHIRTHTGEKPFACDICGRKFACREYRGKHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1005 - protein, 898 aa, Synthetic construct
  REGION 1..898: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPAAMAERPFQCRICMRNFSQSANRTTHIRTHTGEKPFACDICGRKFARSANLTRHTKIHTGSQKPFQCRICMRNFSRSDVLSEHIRTHTGEKPFACDICGRKFATSGHLSRHTKIHTGSQKPFQCRICMRNFSQSSDLSRHIRTHTGEKPFACDICGRKFAQWSTRKRHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1006 - protein, 898 aa, Synthetic construct
  REGION 1..898: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPAAMAERPFQCRICMRNFSQSGNLARHIRTHTGEKPFACDICGRKFAATCCLAHHTKIHTGSQKPFQCRICMRNFSRWQYLPTHIRTHAGEKPFACDICGRKFADRSALARHTKIHTGSQKPFQCRICMRNFSRSDNLSEHIRTHTGEKPFACDICGRKFAKRCNLRCHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1007 - protein, 898 aa, Synthetic construct
  REGION 1..898: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPAAMAERPFQCRICMRNFSNPANLTRHIRTHTGEKPFACDICGRKFAQNATRTKHTKIHTGSQKPFQCRICMRNFSQSGHLARHIRTHTGEKPFACDICGRKFANRHDRAKHTKIHTGSQKPFQCRICMRNFSRSDHLSEHIRTHTGEKPFACDICGRKFAQRRSRYKHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1008 - protein, 898 aa, Synthetic construct
  REGION 1..898: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPAAMAERPFQCRICMRNFSQSSDLSRHIRTHTGEKPFACDICGRKFAHRSTRNRHTKIHTGSQKPFQCRICMRNFSRSDVLSAHIRTHTGEKPFACDICGRKFADSRTRKNHTKIHTGSQKPFQCRICMRNFSQSGSLTRHIRTHTGEKPFACDICGRKFADQSGLAHHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1009 - protein, 898 aa, Synthetic construct
  REGION 1..898: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPAAMAERPFQCRICMRNFSQNPAQWRHIRTHTGEKPFACDICGRKFARSADLSRHTKIHTGSQKPFQCRICMRNFSTSGSLSRHIRTHTGEKPFACDICGRKFARSDHLSRHTKIHTGSQKPFQCRICMRNFSRSDSLLRHIRTHTGEKPFACDICGRKFAQSYDRFQHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1010 - protein, 898 aa, Synthetic construct
  REGION 1..898: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPAAMAERPFQCRICMRNFSTSGSLSRHIRTHTGEKPFACDICGRKFARSDHLSRHTKIHTGSQKPFQCRICMRNFSRSDSLLRHIRTHTGEKPFACDICGRKFAQSYDRFQHTKIHTGSQKPFQCRICMRNFSRSDNLSTHIRTHTGEKPFACDICGRKFADNRDRIKHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1011 - protein, 898 aa, Synthetic construct
  REGION 1..898: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPAAMAERPFQCRICMRNFSDRSNLSRHIRTHTGEKPFACDICGRKFALRQNLIMHTKIHTGSQKPFQCRICMRNFSERGTLARHIRTHTGEKPFACDICGRKFARSDALTQHTKIHTGSQKPFQCRICMRNFSRSDSLSQHIRTHTGEKPFACDICGRKFARKADRTRHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1012 - protein, 898 aa, Synthetic construct
  REGION 1..898: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPAAMAERPFQCRICMRNFSQYCCLTNHIRTHTGEKPFACDICGRKFATSGNLTRHTKIHTGSQKPFQCRICMRNFSQSSDLSRHIRTHTGEKPFACDICGRKFAFRYYLKRHTKIHTGSQKPFQCRICMRNFSQSGDLTRHIRTHTGEKPFACDICGRKFADKGNLTKHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1013 - protein, 898 aa, Synthetic construct
  REGION 1..898: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPAAMAERPFQCRICMRNFSTSGSLSRHIRTHTGEKPFACDICGRKFARSDNLTTHTKIHTGSQKPFQCRICMRNFSQSGNLARHIRTHTGEKPFACDICGRKFADRTTLMRHTKIHTGSQKPFQCRICMRNFSQSGHLARHIRTHTGEKPFACDICGRKFAQLTHLNSHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1014 - protein, 898 aa, Synthetic construct
  REGION 1..898: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPAAMAERPFQCRICMRNFSIKHDLHRHIRTHTGEKPFACDICGRKFARSANLTRHTKIHTGSQKPFQCRICMRNFSRSDNLARHIRTHTGEKPFACDICGRKFAQNVSRPRHTKIHTGSQKPFQCRICMRNFSRSDDLSKHIRTHTGEKPFACDICGRKFADSSHRTRHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1015 - protein, 898 aa, Synthetic construct
  REGION 1..898: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPAAMAERPFQCRICMRNFSRSDNLARHIRTHTGEKPFACDICGRKFAQNVSRPRHTKIHTGSQKPFQCRICMRNFSRSDDLSKHIRTHTGEKPFACDICGRKFADSSHRTRHTKIHTGSQKPFQCRICMRNFSTSSNRKTHIRTHTGEKPFACDICGRKFAAQWTRACHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1016 - protein, 898 aa, Synthetic construct
  REGION 1..898: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPAAMAERPFQCRICMRNFSRSDDLSKHIRTHTGEKPFACDICGRKFADSSHRTRHTKIHTGSQKPFQCRICMRNFSTSSNRKTHIRTHTGEKPFACDICGRKFAAQWTRACHTKIHTGSQKPFQCRICMRNFSRKQTRTTHIRTHTGEKPFACDICGRKFAHRSSLRRHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1017 - protein, 898 aa, Synthetic construct
  REGION 1..898: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPAAMAERPFQCRICMRNFSQSAHRKNHIRTHTGEKPFACDICGRKFATSSNRKTHTKIHTGSQKPFQCRICMRNFSRSDNLSAHIRTHTGEKPFACDICGRKFARNNDRKTHTKIHTGSQKPFQCRICMRNFSTSGSLSRHIRTHTGEKPFACDICGRKFAQAGHLAKHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1018 - protein, 898 aa, Synthetic construct
  REGION 1..898: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPAAMAERPFQCRICMRNFSRSDHLSQHIRTHTGEKPFACDICGRKFAASSTRTKHTKIHTGSQKPFQCRICMRNFSRSDDLTRHIRTHTGEKPFACDICGRKFAQKSNLSSHTKIHTGSQKPFQCRICMRNFSQSANRTTHIRTHTGEKPFACDICGRKFAQNATRTKHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1019 - protein, 898 aa, Synthetic construct
  REGION 1..898: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPAAMAERPFQCRICMRNFSRSDTLSEHIRTHTGEKPFACDICGRKFARRWTLVGHTKIHTGSQKPFQCRICMRNFSDRSNLSRHIRTHTGEKPFACDICGRKFAQSGDLTRHTKIHTGSQKPFQCRICMRNFSQSSDLSRHIRTHTGEKPFACDICGRKFAYHWYLKKHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1020 - protein, 898 aa, Synthetic construct
  REGION 1..898: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPAAMAERPFQCRICMRNFSRSANLARHIRTHTGEKPFACDICGRKFARSDNLREHTKIHTGSQKPFQCRICMRNFSRPYTLRLHIRTHTGEKPFACDICGRKFAHRSNLNKHTKIHTGSQKPFQCRICMRNFSQSGSLTRHIRTHTGEKPFACDICGRKFATSANLSRHTKIHLRQKDAARGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1021 - protein, 894 aa, Synthetic construct
  REGION 1..894: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPLEPGEKPYACPECGKSFSRSDDLVRHQRTHTGEKPYKCPECGKSFSTSGSLVRHQRTHTGEKPYKCPECGKSFSRSDKLVRHQRTHTGEKPYACPECGKSFSRSDELVRHQRTHTGEKPYKCPECGKSFSTSHSLTEHQRTHTGEKPYKCPECGKSFSRADNLTEHQRTHTGKKTSGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1022 - protein, 894 aa, Synthetic construct
  REGION 1..894: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPLEPGEKPYACPECGKSFSERSHLREHQRTHTGEKPYKCPECGKSFSTSHSLTEHQRTHTGEKPYKCPECGKSFSQAGHLASHQRTHTGEKPYACPECGKSFSTSHSLTEHQRTHTGEKPYKCPECGKSFSDPGHLVRHQRTHTGEKPYKCPECGKSFSTSGNLVRHQRTHTGKKTSGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1023 - protein, 894 aa, Synthetic construct
  REGION 1..894: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPLEPGEKPYKCPECGKSFSRADNLTEHQRTHTGEKPYKCPECGKSFSTSGSLVRHQRTHTGEKPYKCPECGKSFSRKDNLKNHQRTHTGEKPYKCPECGKSFSQSSSLVRHQRTHTGEKPYKCPECGKSFSRSDKLVRHQRTHTGEKPYKCPECGKSFSDSGNLRVHQRTHTGKKTSGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1024 - protein, 894 aa, Synthetic construct
  REGION 1..894: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPLEPGEKPYACPECGKSFSQSSSLVRHQRTHTGEKPYKCPECGKSFSQSGDLRRHQRTHTGEKPYKCPECGKSFSRSDERKRHQRTHTGEKPYACPECGKSFSHRTTLTNHQRTHTGEKPYKCPECGKSFSRSDHLTNHQRTHTGEKPYKCPECGKSFSTSGELVRHQRTHTGKKTSGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1025 - protein, 894 aa, Synthetic construct
  REGION 1..894: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPLEPGEKPYACPECGKSFSQSGDLRRHQRTHTGEKPYKCPECGKSFSRSDERKRHQRTHTGEKPYKCPECGKSFSHRTTLTNHQRTHTGEKPYACPECGKSFSRSDHLTNHQRTHTGEKPYKCPECGKSFSTSGELVRHQRTHTGEKPYKCPECGKSFSRSDDLVRHQRTHTGKKTSGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1026 - protein, 894 aa, Synthetic construct
  REGION 1..894: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPLEPGEKPYACPECGKSFSQRAHLERHQRTHTGEKPYKCPECGKSFSQLAHLRAHQRTHTGEKPYKCPECGKSFSDPGHLVRHQRTHTGEKPYACPECGKSFSRRSACRRHQRTHTGEKPYKCPECGKSFSRSDHLTTHQRTHTGEKPYKCPECGKSFSQSSSLVRHQRTHTGKKTSGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1027 - protein, 894 aa, Synthetic construct
  REGION 1..894: note = 3xFLAG-DNMT3AL-XTEN80-SV40 NLS-ZFP-SV40 NLS-KRAB (AA sequence)
MHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGMAPKKKRKVGRVPLEPGEKPYACPECGKSFSQSSNLVRHQRTHTGEKPYKCPECGKSFSRSDDLVRHQRTHTGEKPYKCPECGKSFSTHLDLIRHQRTHTGEKPYACPECGKSFSTSGNLTEHQRTHTGEKPYKCPECGKSFSRRSACRRHQRTHTGEKPYKCPECGKSFSRNDTLTEHQRTHTGKKTSGSGPKKKRKVNGGGGSRTLVTFKDVFVDFTREEWKLLDTAQQIVYRNVMLENYKNLVSLGYQLTKPDVILRLEKGEEPWLV

SEQ ID NO: 1028 - DNA, 18 bp, Synthetic construct
  misc_feature 1..18: note = ZFP target DNA sequence
  source 1..18: mol_type = other DNA
caagtgtttgctgacgca

SEQ ID NO: 1029 - DNA, 18 bp, Synthetic construct
  misc_feature 1..18: note = ZFP target DNA sequence
  source 1..18: mol_type = other DNA
ggctggggcttggtcatg

SEQ ID NO: 1030 - DNA, 18 bp, Synthetic construct
  misc_feature 1..18: note = ZFP target DNA sequence
  source 1..18: mol_type = other DNA
gctggggcttggtcatgg

SEQ ID NO: 1031 - DNA, 18 bp, Synthetic construct
  misc_feature 1..18: note = ZFP target DNA sequence
  source 1..18: mol_type = other DNA
ttggtcatgggccatcag

SEQ ID NO: 1032 - DNA, 18 bp, Synthetic construct
  misc_feature 1..18: note = ZFP target DNA sequence
  source 1..18: mol_type = other DNA
tgcgtggaaccttttcgg

SEQ ID NO: 1033 - DNA, 18 bp, Synthetic construct
  misc_feature 1..18: note = ZFP target DNA sequence
  source 1..18: mol_type = other DNA
gcagcaggtctggagcaa

SEQ ID NO: 1034 - DNA, 18 bp, Synthetic construct
  misc_feature 1..18: note = ZFP target DNA sequence
  source 1..18: mol_type = other DNA
cagcaggtctggagcaaa

SEQ ID NO: 1035 - DNA, 18 bp, Synthetic construct
  misc_feature 1..18: note = ZFP target DNA sequence
  source 1..18: mol_type = other DNA
agcaggtctggagcaaac

SEQ ID NO: 1036 - DNA, 18 bp, Synthetic construct
  misc_feature 1..18: note = ZFP target DNA sequence
  source 1..18: mol_type = other DNA
atcgtatccatggctgct

SEQ ID NO: 1037 - DNA, 18 bp, Synthetic construct
  misc_feature 1..18: note = ZFP target DNA sequence
  source 1..18: mol_type = other DNA
ccagtgggggttgcgtca

SEQ ID NO: 1038 - DNA, 18 bp, Synthetic construct
  misc_feature 1..18: note = ZFP target DNA sequence
  source 1..18: mol_type = other DNA
ccccagccagtgggggtt

SEQ ID NO: 1039 - DNA, 18 bp, Synthetic construct
  misc_feature 1..18: note = ZFP target DNA sequence
  source 1..18: mol_type = other DNA
gcgctgatggcccatgac

SEQ ID NO: 1040 - DNA, 18 bp, Synthetic construct
  misc_feature 1..18: note = ZFP target DNA sequence
  source 1..18: mol_type = other DNA
cacgcacgcgctgatggc

SEQ ID NO: 1041 - DNA, 18 bp, Synthetic construct
  misc_feature 1..18: note = ZFP target DNA sequence
  source 1..18: mol_type = other DNA
agaggagccgaaaaggtt

SEQ ID NO: 1042 - DNA, 18 bp, Synthetic construct
  misc_feature 1..18: note = ZFP target DNA sequence
  source 1..18: mol_type = other DNA
ggatcggcagaggagccg

SEQ ID NO: 1043 - DNA, 18 bp, Synthetic construct
  misc_feature 1..18: note = ZFP target DNA sequence
  source 1..18: mol_type = other DNA
cagtatggatcggcagag

SEQ ID NO: 1044 - DNA, 18 bp, Synthetic construct
  misc_feature 1..18: note = ZFP target DNA sequence
  source 1..18: mol_type = other DNA
gttccgcagtatggatcg

SEQ ID NO: 1045 - DNA, 18 bp, Synthetic construct
  misc_feature 1..18: note = ZFP target DNA sequence
  source 1..18: mol_type = other DNA
ggagttccgcagtatgga

SEQ ID NO: 1046 - DNA, 18 bp, Synthetic construct
  misc_feature 1..18: note = ZFP target DNA sequence
  source 1..18: mol_type = other DNA
gcaaaacaagcggctagg

SEQ ID NO: 1047 - DNA, 18 bp, Synthetic construct
  misc_feature 1..18: note = ZFP target DNA sequence
  source 1..18: mol_type = other DNA
tttgctccagacctgctg

SEQ ID NO: 1048 - DNA, 18 bp, Synthetic construct
  misc_feature 1..18: note = ZFP target DNA sequence
  source 1..18: mol_type = other DNA
gatgtatatttgcgggag

SEQ ID NO: 1049 - DNA, 18 bp, Synthetic construct
  misc_feature 1..18: note = ZFP target DNA sequence
  source 1..18: mol_type = other DNA
cagccagtgggggttgcg

SEQ ID NO: 1050 - DNA, 18 bp, Synthetic construct
  misc_feature 1..18: note = ZFP target DNA sequence
  source 1..18: mol_type = other DNA
gatggcccatgaccaagc

SEQ ID NO: 1051 - DNA, 18 bp, Synthetic construct
  misc_feature 1..18: note = ZFP target DNA sequence
  source 1..18: mol_type = other DNA
ggggtaaaggttcaggta

SEQ ID NO: 1052 - DNA, 18 bp, Synthetic construct
  misc_feature 1..18: note = ZFP target DNA sequence
  source 1..18: mol_type = other DNA
gctaggagttccgcagta

SEQ ID NO: 1053 - DNA, 18 bp, Synthetic construct
  misc_feature 1..18: note = ZFP target DNA sequence
  source 1..18: mol_type = other DNA
gcggctaggagttccgca

SEQ ID NO: 1054 - DNA, 18 bp, Synthetic construct
  misc_feature 1..18: note = ZFP target DNA sequence
  source 1..18: mol_type = other DNA
gtatggatcggcagagga

SEQ ID NO: 1055 - DNA, 18 bp, Synthetic construct
  misc_feature 1..18: note = ZFP target DNA sequence
  source 1..18: mol_type = other DNA
ccgatccatactgcggaa

SEQ ID NO: 1056 - DNA, 42 bp, Synthetic construct
  misc_feature 1..42: note = 1 bp - 42 bp
  source 1..42: mol_type = other DNA
aattccacaacctttcaccaaactctgcaagatcccagagtg

SEQ ID NO: 1057 - DNA, 448 bp, Synthetic construct
  misc_feature 1..448: note = 43 bp - 490 bp
  source 1..448: mol_type = other DNA
agaggcctgtatttccctgctggtggctccagttcaggagcagtaaaccctgttccgactactgcctctcccttatcgtcaatcttctcgaggattggggaccctgcgctgaacatggagaacatcacatcaggattcctaggaccccttctcgtgttacaggcggggtttttcttgttgacaagaatcctcacaataccgcagagtctagactcgtggtggacttctctcaattttctagggggaactaccgtgtgtcttggccaaaattcgcagtccccaacctccaatcactcaccaacctcctgtcctccaacttgtcctggttatcgctggatgtgtctgcggcgttttatcatcttcctcttcatcctgctgctatgcctcatcttcttgttggttcttctggactatcaaggtatgttgcccgtttgtcctctaattccag

SEQ ID NO: 1058 - DNA, 552 bp, Synthetic construct
  misc_feature 1..552: note = 491 bp - 1032 bp
  source 1..552: mol_type = other DNA
gatcctcaaccaccagcacgggaccatgccgaacctgcatgactactgctcaaggaacctctatgtatccctcctgttgctgtaccaaaccttcggacggaaattgcacctgtattcccatcccatcatcctgggctttcggaaaattcctatgggagtgggcctcagcccgtttctcctggctcagtttactagtgccatttgttcagtggttcgtagggctttcccccactgtttggctttcagttatatggatgatgtggtattgggggccaagtctgtacagcatcttgagtccctttttaccgctgttaccaattttcttttgtctttgggtatacatttaaaccctaacaaaacaaagagatggggttactctctgaattttatgggttatgtcattggaagttatgggtccttgccacaagaacacatcatacaaaaaatcaaagaatgttttagaaaacttcctattaacaggcctattgattggaaagtatgtcaacgaattgtgggtcttttgggttttgctgccccatttacacaatgtgg

SEQ ID NO: 1059 - DNA, 707 bp, Synthetic construct
  misc_feature 1..707: note = 1033 bp - 1749 bp
  source 1..707: mol_type = other DNA
ttatcctgcgttaatgcccttgtatgcatgtattcaatctaagcaggctttcactttctcgccaacttacaaggcctttctgtgtaaacaatacctgaacctttaccccgttgcccggcaacggccaggtctgtgccaagtgtttgctgacgcaacccccactggctggggcttggtcatgggccatcagcgcgtgcgtggaaccttttcggctcctctgccgatccatactgcggaactcctagccgcttgttttgctcgcagcaggtctggagcaaacattatcgggactgataactctgttgtcctctcccgcaaatatacatcgtatccatggctgctaggctgtgctgccaactggatcctgcgcgggacgtcctttgtttacgtcccgtcggcgctgaatcctgcggacgacccttctcggggtcgcttgggactctctcgtccccttctccgtctgccgttccgaccgaccacggggcgcacctctctttacgcggactccccgtctgtgccttctcatctgccggaccgtgtgcacttcgcttcacctctgcacgtcgcatggagaccaccgtgaacgcccaccgaatgttgcccaaggtcttacataagaggactcttggactctctgcaatgtcaacgaccgaccttgaggcatacttcaaagactgtttgtttaaagactgggaggagttggggga

SEQ ID NO: 1060 - DNA, 50 bp, Synthetic construct
  misc_feature 1..50: note = 1750 bp - 1799 bp
  source 1..50: mol_type = other DNA
ggagattagattaaaggtctttgtactaggaggctgtaggcataaattgg

SEQ ID NO: 1061 - DNA, 161 bp, Synthetic construct
  misc_feature 1..161: note = 1800 bp - 1950 bp
  source 1..161: mol_type = other DNA
tctgcgcaccagcaccatgcaactttttcacctctgcctaatcatctcttgttcatgtcctactgttcaagcctccaagctgtgccttgggtggctttggggcatggacatcgacccttataaagaatttggagctactgtggagttactctcgtttttgc

SEQ ID NO: 1062 - DNA, 992 bp, Synthetic construct
  misc_feature 1..992: note = 1951 bp -2952
  source 1..992: mol_type = other DNA
cttctgacttctttccttcagtacgagatcttctagataccgcctcagctctgtatcgggaagccttagagtctcctgagcattgttcacctcaccatactgcactcaggcaagcaattctttgctggggggaactaatgactctagctacctgggtgggtgttaatttggaagatccagcatctagagacctagtagtcagttatgtcaacactaatatgggcctaaagttcaggcaactcttgtggtttcacatttcttgtctcacttttggaagagaaaccgttatagagtatttggtgtctttcggagtgtggattcgcactcctccagcttatagaccaccaaatgcccctatcctatcaacacttccggaaactactgttgttagacgacgaggcaggtcccctagaagaagaactccctcgcctcgcagacgaaggtctcaatcgccgcgtcgcagaagatctcaatctcgggaacctcaatgttagtattccttggactcataaggtggggaactttactggtctttattcttctactgtacctgtctttaatcctcattggaaaacaccatcttttcctaatatacatttacaccaagacattatcaaaaaatgtgaacagtttgtaggcccacttacagttaatgagaaaagaagattgcaattgattatgcctgctaggttttatccaaaggttaccaaatatttaccattggataagggtattaaaccttattatccagaacatctagttaatcattacttccaaactagacactatttacacactctatggaaggcgggtatattatataagagagaaacaacacatagcgcctcattttgtgggtcaccatattcttgggaacaagatctacagcatggggcagaatctttccaccagcaatcctctgggattctttcccgaccaccagttggatccagccttcagagcaaacacagcaaatccagattgggacttca

SEQ ID NO: 1063 - DNA, 230 bp, Synthetic construct
  misc_feature 1..230: note = 2953 bp - 3182
  source 1..230: mol_type = other DNA
atcccaacaaggacacctggccagacgccaacaaggtaggagctggagcattcgggctgggtttcaccccaccgcacggaggccttttggggtggagccctcaggctcagggcatactacaaactttgccagcaaatccgcctcctgcctccaccaatcgccagacaggaaggcagcctaccccgctgtctccacctttgagaaacactcatcctcaggccatgcagtgg

SEQ ID NO: 1064 - DNA, 336 bp, Synthetic construct
  misc_feature 1..336: note = 67 bp   392 bp
  source 1..336: mol_type = other DNA
ggctccagttcaggagcagtaaaccctgttccgactactgcctctcccttatcgtcaatcttctcgaggattggggaccctgcgctgaacatggagaacatcacatcaggattcctaggaccccttctcgtgttacaggcggggtttttcttgttgacaagaatcctcacaataccgcagagtctagactcgtggtggacttctctcaattttctagggggaactaccgtgtgtcttggccaaaattcgcagtccccaacctccaatcactcaccaacctcctgtcctccaacttgtcctggttatcgctggatgtgtctgcggcgttttatcatc

SEQ ID NO: 1065 - DNA, 717 bp, Synthetic construct
  misc_feature 1..717: note = 1033 bp -1749 bp
  source 1..717: mol_type = other DNA
cacaatgtggttatcctgcgttaatgcccttgtatgcatgtattcaatctaagcaggctttcactttctcgccaacttacaaggcctttctgtgtaaacaatacctgaacctttaccccgttgcccggcaacggccaggtctgtgccaagtgtttgctgacgcaacccccactggctggggcttggtcatgggccatcagcgcgtgcgtggaaccttttcggctcctctgccgatccatactgcggaactcctagccgcttgttttgctcgcagcaggtctggagcaaacattatcgggactgataactctgttgtcctctcccgcaaatatacatcgtatccatggctgctaggctgtgctgccaactggatcctgcgcgggacgtcctttgtttacgtcccgtcggcgctgaatcctgcggacgacccttctcggggtcgcttgggactctctcgtccccttctccgtctgccgttccgaccgaccacggggcgcacctctctttacgcggactccccgtctgtgccttctcatctgccggaccgtgtgcacttcgcttcacctctgcacgtcgcatggagaccaccgtgaacgcccaccgaatgttgcccaaggtcttacataagaggactcttggactctctgcaatgtcaacgaccgaccttgaggcatacttcaaagactgtttgtttaaagactgggaggagttggggga

SEQ ID NO: 1066 - DNA, 286 bp, Synthetic construct
  misc_feature 1..286: note = 2215 bp   2490
  source 1..286: mol_type = other DNA
gtggtttcacatttcttgtctcacttttggaagagaaaccgttatagagtatttggtgtctttcggagtgtggattcgcactcctccagcttatagaccaccaaatgcccctatcctatcaacacttccggaaactactgttgttagacgacgaggcaggtcccctagaagaagaactccctcgcctcgcagacgaaggtctcaatcgccgcgtcgcagaagatctcaatctcgggaacctcaatgttagtattccttggactcataaggtggggaactttactgg

SEQ ID NO: 1067 - DNA, 421 bp, Synthetic construct
  misc_feature 1..421: note = 1060-1480 bp
  source 1..421: mol_type = other DNA
ccttgtatgcatgtattcaatctaagcaggctttcactttctcgccaacttacaaggcctttctgtgtaaacaatacctgaacctttaccccgttgcccggcaacggccaggtctgtgccaagtgtttgctgacgcaacccccactggctggggcttggtcatgggccatcagcgcgtgcgtggaaccttttcggctcctctgccgatccatactgcggaactcctagccgcttgttttgctcgcagcaggtctggagcaaacattatcgggactgataactctgttgtcctctcccgcaaatatacatcgtatccatggctgctaggctgtgctgccaactggatcctgcgcgggacgtcctttgtttacgtcccgtcggcgctgaatcctgcggacgacccttctcggggtcgcttggg

SEQ ID NO: 1068 - DNA, 125 bp, Synthetic construct
  misc_feature 1..125: note = 1250-1374 bp
  source 1..125: mol_type = other DNA
ttcggctcctctgccgatccatactgcggaactcctagccgcttgttttgctcgcagcaggtctggagcaaacattatcgggactgataactctgttgtcctctcccgcaaatatacatcgtatc

SEQ ID NO: 1069 - DNA, 48 bp, Synthetic construct
  misc_feature 1..48: note = 1255-1302 bp
  source 1..48: mol_type = other DNA
ctcctctgccgatccatactgcggaactcctagccgcttgttttgctc

SEQ ID NO: 1070 - DNA, 41 bp, Synthetic construct
  misc_feature 1..41: note = 1260-1300 bp
  source 1..41: mol_type = other DNA
ctgccgatccatactgcggaactcctagccgcttgttttgc

SEQ ID NO: 1071 - DNA, 3182 bp, synthetic construct
  source 1..3182: mol_type = other DNA
  misc_feature 1..3182: note = Hepatitis B Virus genome-2
ttccacaacctttcaccaaactctgcaagatcccagagtgagaggcctgtatttccctgctggtggctccagttcaggagcagtaaaccctgttccgactactgcctctcccttatcgtcaatcttctcgaggattggggaccctgcgctgaacatggagaacatcacatcaggattcctaggaccccttctcgtgttacaggcggggtttttcttgttgacaagaatcctcacaataccgcagagtctagactcgtggtggacttctctcaattttctagggggaactaccgtgtgtcttggccaaaattcgcagtccccaacctccaatcactcaccaacctcctgtcctccaacttgtcctggttatcgctggatgtgtctgcggcgttttatcatcttcctcttcatcctgctgctatgcctcatcttcttgttggttcttctggactatcaaggtatgttgcccgtttgtcctctaattccaggatcctcaaccaccagcacgggaccatgccgaacctgcatgactactgctcaaggaacctctatgtatccctcctgttgctgtaccaaaccttcggacggaaattgcacctgtattcccatcccatcatcctgggctttcggaaaattcctatgggagtgggcctcagcccgtttctcctggctcagtttactagtgccatttgttcagtggttcgtagggctttcccccactgtttggctttcagttatatggatgatgtggtattgggggccaagtctgtacagcatcttgagtccctttttaccgctgttaccaattttcttttgtctttgggtatacatttaaaccctaacaaaacaaagagatggggttactctctgaattttatgggttatgtcattggaagttatgggtccttgccacaagaacacatcatacaaaaaatcaaagaatgttttagaaaacttcctattaacaggcctattgattggaaagtatgtcaacgaattgtgggtcttttgggttttgctgccccatttacacaatgtggttatcctgcgttaatgcccttgtatgcatgtattcaatctaagcaggctttcactttctcgccaacttacaaggcctttctgtgtaaacaatacctgaacctttaccccgttgcccggcaacggccaggtctgtgccaagtgtttgctgacgcaacccccactggctggggcttggtcatgggccatcagcgcgtgcgtggaaccttttcggctcctctgccgatccatactgcggaactcctagccgcttgttttgctcgcagcaggtctggagcaaacattatcgggactgataactctgttgtcctctcccgcaaatatacatcgtatccatggctgctaggctgtgctgccaactggatcctgcgcgggacgtcctttgtttacgtcccgtcggcgctgaatcctgcggacgacccttctcggggtcgcttgggactctctcgtccccttctccgtctgccgttccgaccgaccacggggcgcacctctctttacgcggactccccgtctgtgccttctcatctgccggaccgtgtgcacttcgcttcacctctgcacgtcgcatggagaccaccgtgaacgcccaccgaatgttgcccaaggtcttacataagaggactcttggactctctgcaatgtcaacgaccgaccttgaggcatacttcaaagactgtttgtttaaagactgggaggagttgggggaggagattagattaaaggtctttgtactaggaggctgtaggcataaattggtctgcgcaccagcaccatgcaactttttcacctctgcctaatcatctcttgttcatgtcctactgttcaagcctccaagctgtgccttgggtggctttggggcatggacatcgacccttataaagaatttggagctactgtggagttactctcgtttttgccttctgacttctttccttcagtacgagatcttctagataccgcctcagctctgtatcgggaagccttagagtctcctgagcattgttcacctcaccatactgcactcaggcaagcaattctttgctggggggaactaatgactctagctacctgggtgggtgttaatttggaagatccagcatctagagacctagtagtcagttatgtcaacactaatatgggcctaaagttcaggcaactcttgtggtttcacatttcttgtctcacttttggaagagaaaccgttatagagtatttggtgtctttcggagtgtggattcgcactcctccagcttatagaccaccaaatgcccctatcctatcaacacttccggaaactactgttgttagacgacgaggcaggtcccctagaagaagaactccctcgcctcgcagacgaaggtctcaatcgccgcgtcgcagaagatctcaatctcgggaacctcaatgttagtattccttggactcataaggtggggaactttactggtctttattcttctactgtacctgtctttaatcctcattggaaaacaccatcttttcctaatatacatttacaccaagacattatcaaaaaatgtgaacagtttgtaggcccacttacagttaatgagaaaagaagattgcaattgattatgcctgctaggttttatccaaaggttaccaaatatttaccattggataagggtattaaaccttattatccagaacatctagttaatcattacttccaaactagacactatttacacactctatggaaggcgggtatattatataagagagaaacaacacatagcgcctcattttgtgggtcaccatattcttgggaacaagatctacagcatggggcagaatctttccaccagcaatcctctgggattctttcccgaccaccagttggatccagccttcagagcaaacacagcaaatccagattgggacttcaatcccaacaaggacacctggccagacgccaacaaggtaggagctggagcattcgggctgggtttcaccccaccgcacggaggccttttggggtggagccctcaggctcagggcatactacaaactttgccagcaaatccgcctcctgcctccaccaatcgccagacaggaaggcagcctaccccgctgtctccacctttgagaaacactcatcctcaggccatgcagtggaa

SEQ ID NO: 1072 - DNA, 110 bp, Hepatitis B virus
  source 1..110: mol_type = unassigned DNA
gcttggtcatgggccatcagcgcgtgcgtggaaccttttcggctcctctgccgatccatactgcggaactcctagccgcttgttttgctcgcagcaggtctggagcaaac

What is claimed:

1. An epigenetic-modifying DNA-targeting system comprising a DNA-targeting module for repressing transcription of one or more Hepatitis B viral (HBV) genes, wherein the DNA-targeting module comprises: (a) a gRNA for targeting to a target site in a Hepatitis B viral DNA sequence, wherein the target site is in a regulatory element positioned between residue 1033 and a transcription start site of the HBx gene at residue base pair 1376 of a Hepatitis B viral sequence with reference to nucleotide positions of SEQ ID NO: 650; and (b) a fusion protein comprising a deactivated *Streptococcus pyogenes* Cas9 (dSpCas9) protein and at least one transcriptional repressor effector domain comprising a KRAB domain and a DNA methyltransferase 3 (DNMT3) domain that has DNA methyltransferase activity, wherein the one or more HBV genes are present in both a covalently closed circular DNA (cccDNA) form and in HBV viral DNA integrated in human genomic DNA, wherein the epigenetic-modifying DNA-targeting system is capable of repressing transcription of total Hepatitis B viral RNA transcript levels.

2. The epigenetic-modifying DNA-targeting system of claim 1, wherein the target site is within a target region that has a sequence corresponding to the sequence located at base pairs between 1255-1302 bp with reference to the HBV genome set forth in SEQ ID NO: 650.

3. The epigenetic-modifying DNA-targeting system of claim 2, wherein the dSpCas9 comprises at least 95% sequence identity to the amino acid sequence set forth in SEQ ID NO: 599 and comprises an alanine (A) at amino acid position 9 and an alanine at position 839 corresponding to amino acid residues in SEQ ID NO:599.

4. The epigenetic-modifying DNA-targeting system of claim 1, wherein the target site is within a target region that has a sequence corresponding to the sequence located at base pairs between 1260-1300 bp with reference to the HBV genome set forth in SEQ ID NO: 650.

5. The epigenetic-modifying DNA-targeting system of claim 1, wherein the target site comprises the sequence set forth in SEQ ID NO: 22 or SEQ ID NO:63, a contiguous portion thereof of at least 14 nucleotides, or a complementary sequence of any of the foregoing.

6. The epigenetic-modifying DNA-targeting system of claim 5, wherein the DNA methyltransferase is DNMT3A or DNMT3A-3L.

7. The epigenetic-modifying DNA-targeting system of claim 5, wherein the transcriptional repressor effector domain is a DNMT3A/L-KRAB fusion repressor domain.

8. The epigenetic-modifying DNA-targeting system of claim 5, wherein the dSpCas9 comprises at least 95% sequence identity to the amino acid sequence set forth in SEQ ID NO: 599 and comprises an alanine (A) at amino acid position 9 and an alanine at position 839 corresponding to amino acid residues in SEQ ID NO:599.

9. The epigenetic-modifying DNA-targeting system of claim 1, wherein the dSpCas9 comprises at least one amino acid mutation selected from D10A and H840A, with reference to numbering of positions of SEQ ID NO: 598.

10. The epigenetic-modifying DNA-targeting system of claim 1, wherein the gRNA comprises the sequence set forth in SEQ ID NO: 217, a contiguous portion thereof of at least 14 nucleotides, or a complementary sequence of any of the foregoing.

11. The epigenetic-modifying DNA-targeting system of claim 10, wherein the gRNA is set forth in SEQ ID NO: 412.

12. The epigenetic-modifying DNA-targeting system of claim 1, wherein the gRNA comprises the sequence set forth in SEQ ID NO: 258, a contiguous portion thereof of at least 14 nucleotides, or a complementary sequence of any of the foregoing.

13. The epigenetic-modifying DNA-targeting system of claim 12, wherein the gRNA is set forth in SEQ ID NO: 453.

14. The epigenetic-modifying DNA-targeting system of claim 1, wherein the DNA methyltransferase is DNMT3A or DNMT3A-3L.

15. The epigenetic-modifying DNA-targeting system of claim 1, wherein the transcriptional repressor effector domain is a DNMT3A/L-KRAB fusion repressor domain.

16. The epigenetic-modifying DNA-targeting system of claim 1, wherein the dSpCas9 comprises at least 95% sequence identity to the amino acid sequence set forth in SEQ ID NO: 599 and comprises an alanine (A) at amino acid position 9 and an alanine at position 839 corresponding to amino acid residues in SEQ ID NO:599.

17. A polynucleotide encoding the epigenetic-modifying DNA-targeting system of claim 1.

18. A vector comprising the polynucleotide of claim 17.

19. A polynucleotide encoding the epigenetic-modifying DNA-targeting system of claim 2.

20. A vector comprising the polynucleotide of claim 19.

21. A polynucleotide encoding the epigenetic-modifying DNA-targeting system of claim 5.

22. A vector comprising the polynucleotide of claim 21.

23. A polynucleotide encoding the epigenetic-modifying DNA-targeting system of claim 16.

24. A vector comprising the polynucleotide of claim 23.

25. A polynucleotide encoding the epigenetic-modifying DNA-targeting system of claim 8.

26. A vector comprising the polynucleotide of claim 25.

* * * * *